United States Patent
Dubrovskaya et al.

(10) Patent No.: US 12,428,494 B2
(45) Date of Patent: Sep. 30, 2025

(54) COMPOSITIONS TARGETING PROSTATE-SPECIFIC MEMBRANE ANTIGEN AND METHODS FOR MAKING AND USING THE SAME

(71) Applicant: Amunix Pharmaceuticals, Inc., South San Francisco, CA (US)

(72) Inventors: Viktoriya Dubrovskaya, San Francisco, CA (US); Eric Johansen, Oakland, CA (US); Lucas Liu, San Bruno, CA (US); Darragh MacCann, Magherfelt (GB); Volker Schellenberger, Palo Alto, CA (US); Milton To, San Lorenzo, CA (US)

(73) Assignee: Amunix Pharmaceuticals, Inc., South San Francisco, CA (US)

( * ) Notice: Subject to any disclaimer, the term of this patent is extended or adjusted under 35 U.S.C. 154(b) by 0 days.

(21) Appl. No.: 19/063,190

(22) Filed: Feb. 25, 2025

(65) Prior Publication Data

US 2025/0188184 A1 Jun. 12, 2025

Related U.S. Application Data

(63) Continuation of application No. 18/438,106, filed on Feb. 9, 2024, now abandoned.
(Continued)

(51) Int. Cl.
| | | |
|---|---|---|
| C07K 16/30 | (2006.01) | |
| A61K 39/00 | (2006.01) | |
| A61P 35/00 | (2006.01) | |
| C07K 16/28 | (2006.01) | |

(52) U.S. Cl.
CPC .......... *C07K 16/3069* (2013.01); *A61P 35/00* (2018.01); *C07K 16/2809* (2013.01);
(Continued)

(58) Field of Classification Search
CPC ............ C07K 16/3069; C07K 16/2809; C07K 2317/24; C07K 2317/31; C07K 2317/569;
(Continued)

(56) References Cited

U.S. PATENT DOCUMENTS

2024/0327538 A1* 10/2024 Dubrovskaya .......... A61P 35/00

FOREIGN PATENT DOCUMENTS

| WO | 2020264208 A1 | 12/2020 |
| WO | 2021123810 A1 | 6/2021 |
| WO | 2022125576 A1 | 6/2022 |

OTHER PUBLICATIONS

International Search Report and Written Opinion dated Aug. 30, 2024 for PCT/US2024/015223. 45 pages.
(Continued)

*Primary Examiner* — Mark Halvorson
*Assistant Examiner* — Lea S O'Brien
(74) *Attorney, Agent, or Firm* — Sheppard Mullin Richter & Hampton LLP

(57) ABSTRACT

The disclosure describes antigen-binding molecules with binding specificity to cluster of differentiation 3 T cell receptor (CD3), antigen-binding molecules with binding specificity to prostate-specific membrane antigen (PSMA), cleavable linker sequences, and protease-activatable bispecific fusion proteins such as protease-activatable T cell engagers, as well as uses and methods of treatment.

8 Claims, 48 Drawing Sheets

Specification includes a Sequence Listing.

Related U.S. Application Data

(60) Provisional application No. 63/499,031, filed on Apr. 28, 2023, provisional application No. 63/444,839, filed on Feb. 10, 2023.

(52) U.S. Cl.
CPC .... *A61K 2039/505* (2013.01); *C07K 2317/24* (2013.01); *C07K 2317/31* (2013.01); *C07K 2317/569* (2013.01); *C07K 2317/622* (2013.01); *C07K 2317/92* (2013.01); *C07K 2319/50* (2013.01)

(58) Field of Classification Search
CPC .......... C07K 2317/622; C07K 2317/92; C07K 2319/50; A61P 35/00; A61K 2039/505
See application file for complete search history.

(56) References Cited

OTHER PUBLICATIONS

Chen. Conditionally active T cell engagers for the treatment of solid tumors: rationale and clinical development. Expert Opinion on Biological Therapy. 2022; 22(8):955-963.

DiRaimondo, et al. Preclinical Activity and Safety Profile of JANX007, a Novel PSMA-Targeting Tumor-Activated T Cell Engager for Treatment of Metastatic Castration-Resistant Prostate Cancer. Regular and Young Investigator Award Abstracts. Nov. 1, 2022; A1374.

Tapia-Galisteo, et al. When three is not a crowd: trispecific antibodies for enhanced cancer immunotherapy. Theranostics. 2023; 13(3):1028-1041.

\* cited by examiner

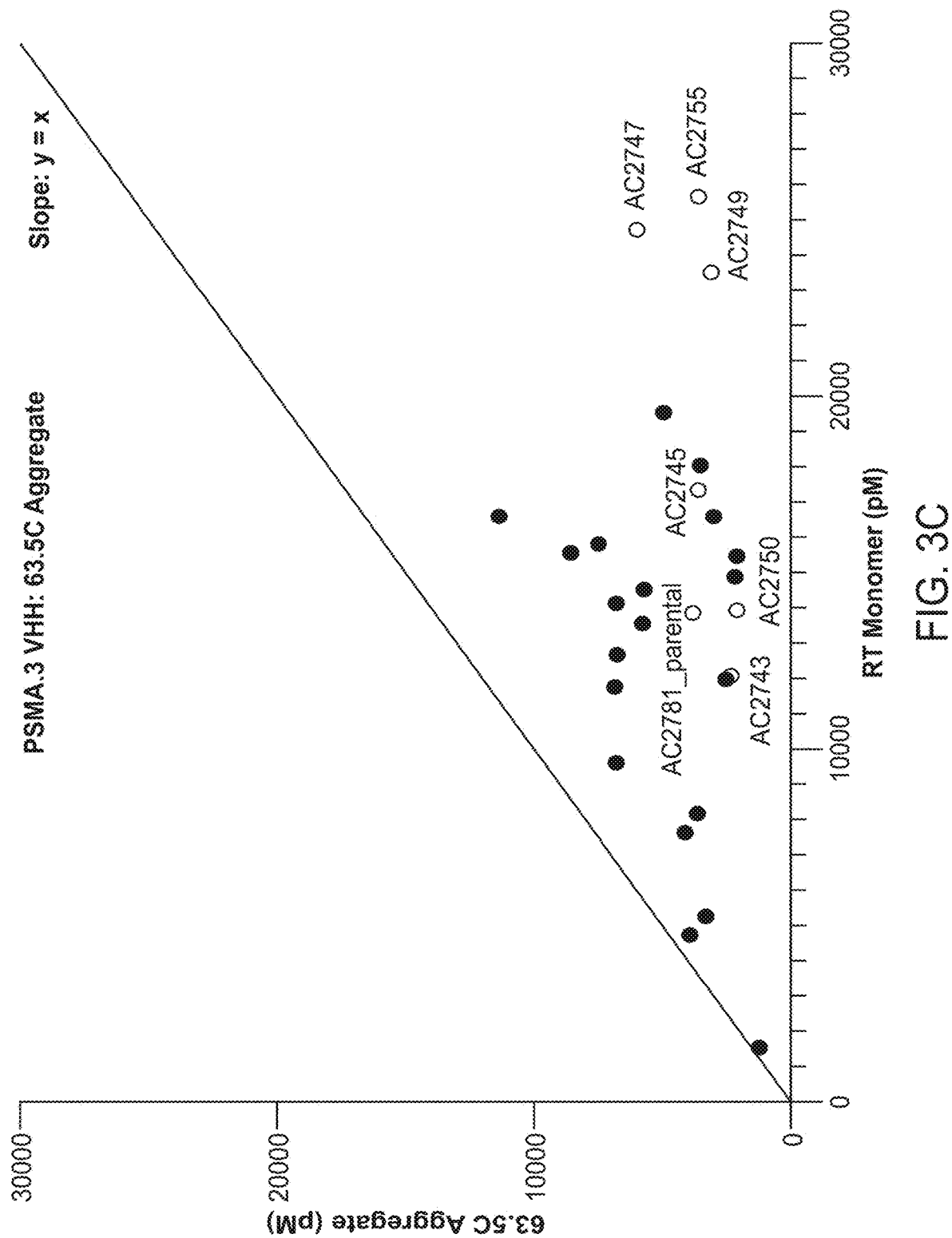

RSR-2295 (SEQ ID NO: 7048) ...EAGRSANHTPAGLTGP  
                                                            Legumain  
RSR-3213 (SEQ ID NO: 7628) ...EAGRSASHTPAGLTGP  
                                         Serine Protease    MMPs (2, 7, 9, 14)

FIG. 7A

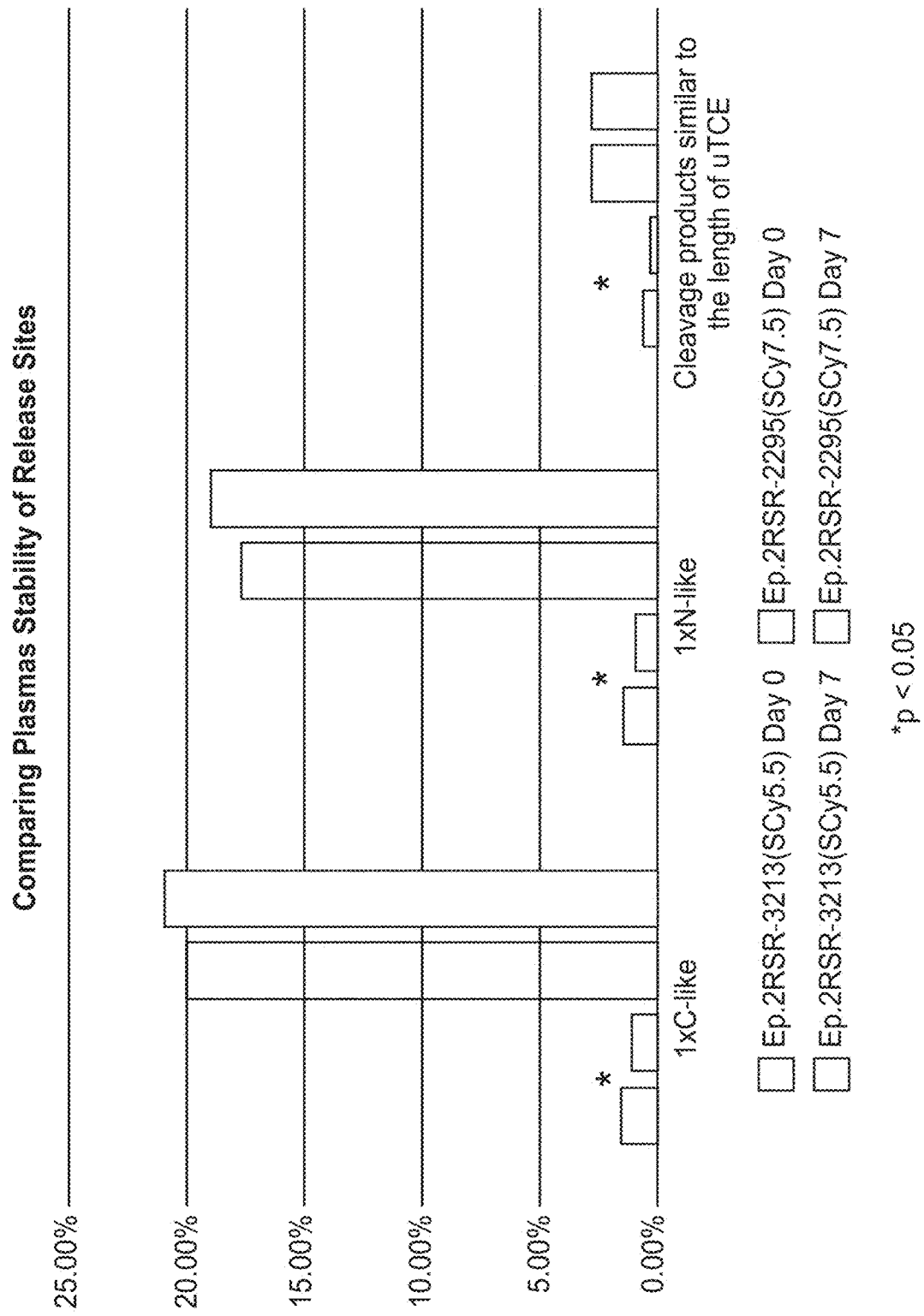

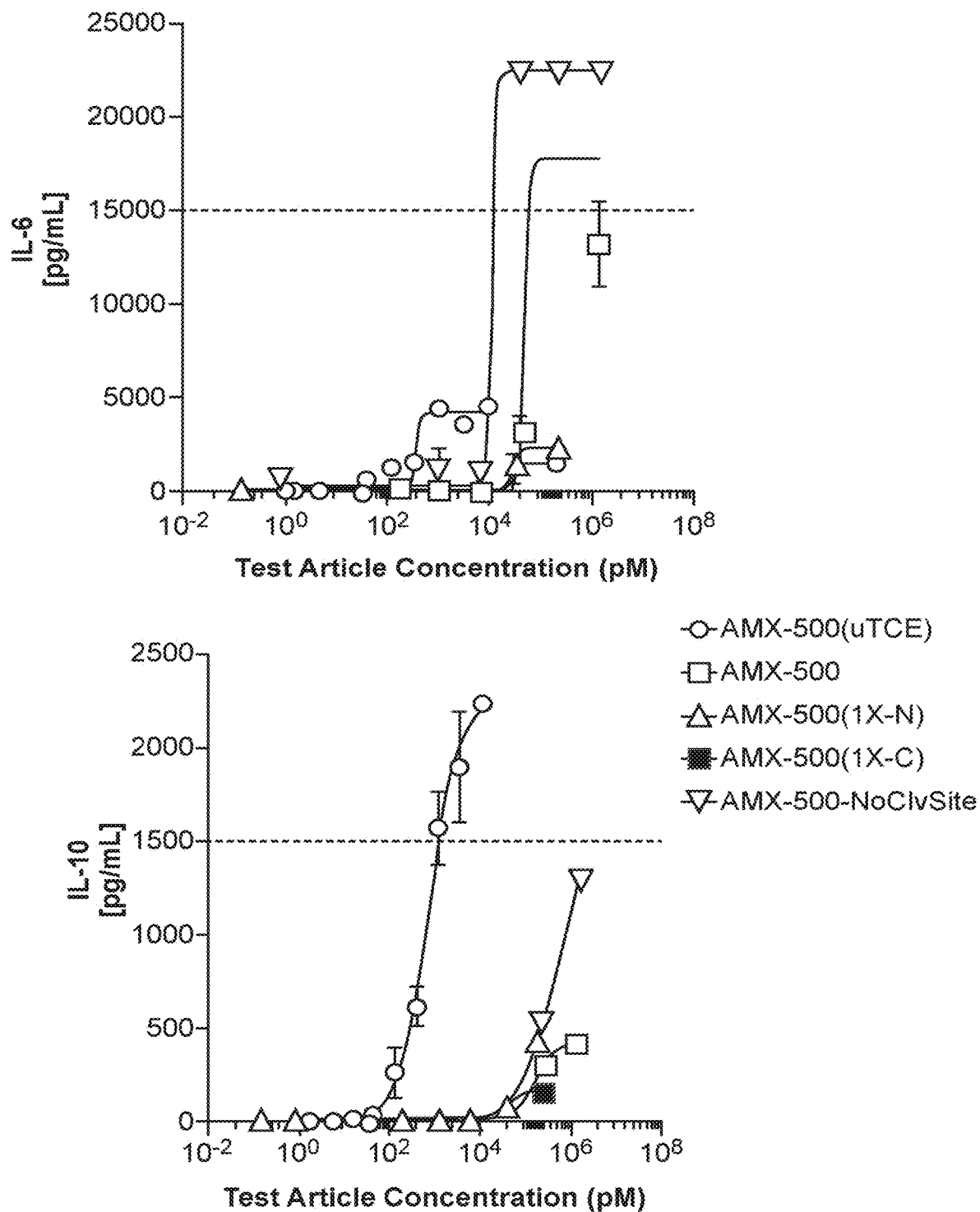
FIG. 15 (Cont. 1)

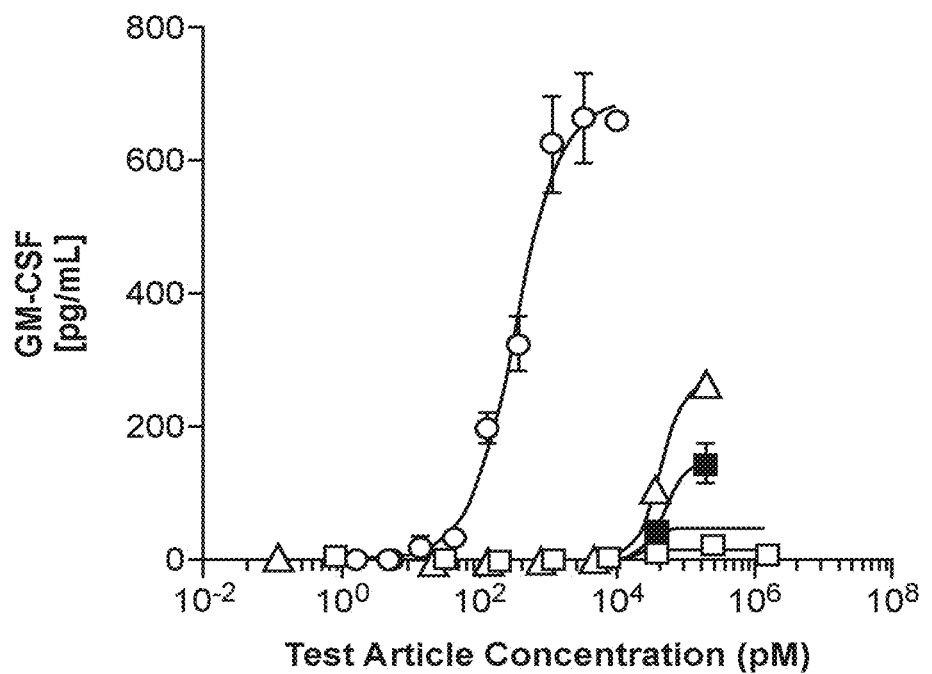
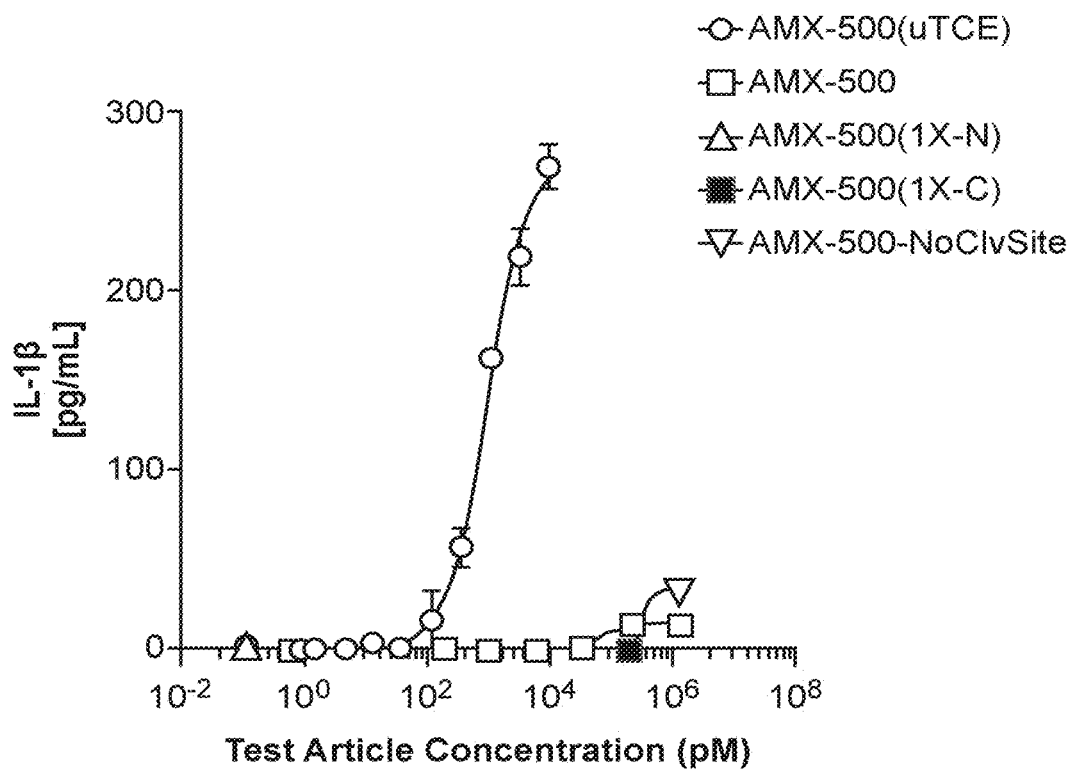
FIG. 15 (Cont. 2)

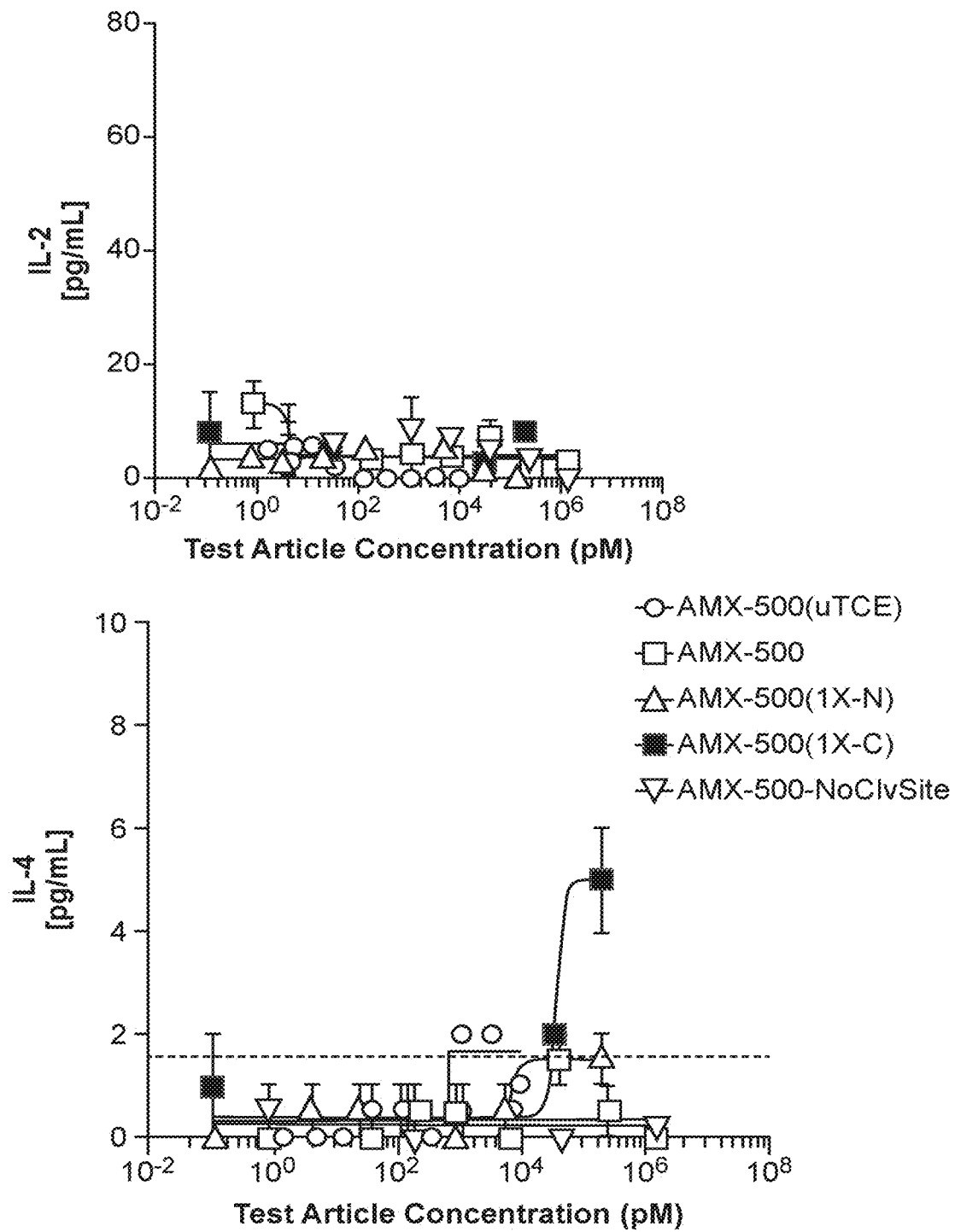
FIG. 15 (Cont. 3)

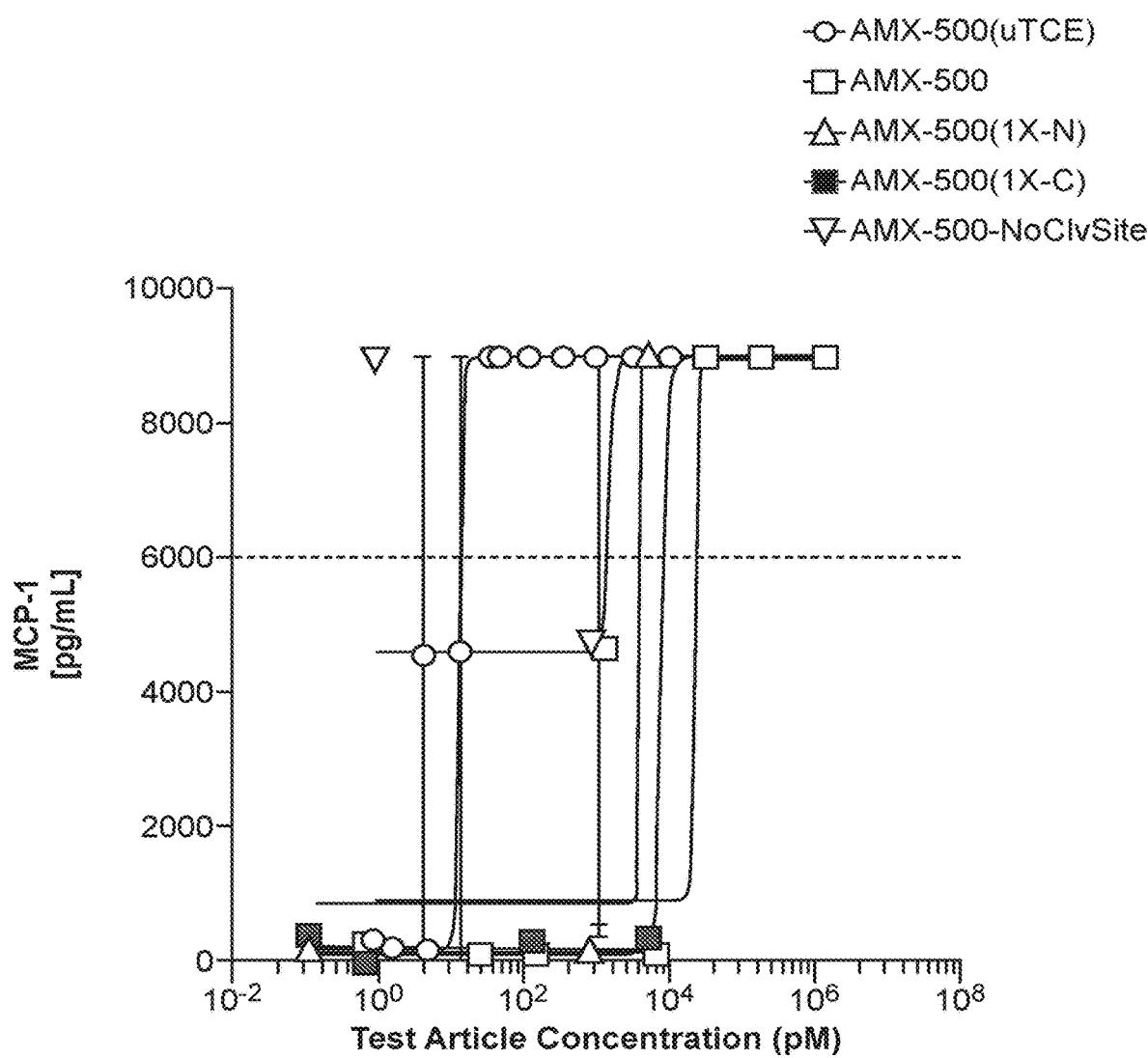
FIG. 15 (Cont. 4)

COMPOSITIONS TARGETING PROSTATE-SPECIFIC MEMBRANE ANTIGEN AND METHODS FOR MAKING AND USING THE SAME

CROSS-REFERENCE TO RELATED APPLICATIONS

This application is a continuation of U.S. application Ser. No. 18/438,106, filed Feb. 9, 2024, which claims priority to U.S. Provisional Patent Application Ser. No. 63/444,839, filed Feb. 10, 2023; and 63/499,031, filed Apr. 28, 2023; the contents of which are hereby incorporated by reference in their entireties.

SEQUENCE LISTING

The instant application contains a Sequence Listing which has been submitted herewith and is hereby incorporated by reference in its entirety. Said .xml copy, created on Feb. 25, 2025, is named 385483.xml, and is 3,320,415 bytes in size.

BACKGROUND

Prostate cancer is the second most common cancer in men and is expected to affect one in nine men in the United States over the course of their lifetimes. Treatment of localized disease (as measured by a Gleason score <6, PSA <10 ng/ml) by radiation, radical prostatectomy, or active surveillance is successful at controlling early-stage disease; however, relapse occurs in 20 to 50% of men. Patients who continue to progress on first- and second-line androgen deprivation therapies (ADT) develop castration-resistant prostate cancer (CRPC), which often metastasizes (mCRPC) to the bone, brain, liver, and lungs. Chemotherapies such as docetaxel and cabazitaxel have demonstrated improved survival in this population, but there is no cure for mCRPC.

Prostate-Specific Membrane Antigen (PSMA; also known as folate hydrolase 1 and FOLH1) is an integral cell surface membrane protein that is frequently overexpressed in prostate cancer and is often associated with androgen-independent prostate cancer and secondary metastatic lesions. PSMA is also expressed within the neovasculature of bladder, renal, gastric, and colorectal carcinomas.

Immunotherapies have demonstrated mixed success, including with respect to prostate cancer. While the first cell-based immunotherapy sipuleucel T (PROVENGE®) was approved in 2010 for mCRPC, checkpoint blockade targeting immunoinhibitory receptors PD-1 and CTLA-4 have shown very little in the way of lowering response rates in prostate cancer compared with other solid tumor malignancies. It has been suggested that this may be due to the immunologically "cold" tumor microenvironment of primary prostate cancer tumors, characterized by low immune cell infiltration, and a weak neoantigen burden shown to be required for response to checkpoint blockade inhibitors.

There is a long-felt and yet unmet need for therapeutic intervention of tumors that express PSMA, including immunologically cold tumors.

BRIEF DESCRIPTION

The present disclosure provides, among other things, antigen-binding molecules with binding specificity to PSMA, antigen-binding molecules with binding specificity to CD3, as well as bispecific antigen-binding molecules that bind both PSMA and CD3 for use in therapeutic settings in which specific targeting and T cell-mediated killing of PSMA-expressing cells is desired. Aspects disclosed herein address a long-felt unmet need for PSMA-targeting cancer therapeutics, including T cell engagers (TCEs) that have an increased therapeutic index. Aspects of the present disclosure also address the long-felt and yet unmet need for the therapeutic intervention of immunologically cold tumors, e.g., solid tumors, that express PSMA. Also included are, e.g., protease cleavable linkers, barcode fragments, antibody domain linkers, and activatable TCEs (including those that do not bind PSMA). Included herein are also fusion proteins, such as non-TCE fusion proteins that target PSMA, CD3, and/or that comprise linkers and other components provided herein.

Certain aspects of the present disclosure include compounds, compositions, and methods for increasing a subject's therapeutic response to a checkpoint inhibitor (e.g., a PD-1 or CTLA-4 inhibitor such as an anti-PD1 antibody or an anti-CTLA4 antibody). In some embodiments, a compound provided herein recruits and activates effector T cells in a major histocompatibility complex-independent manner via engagement of CD3 on T cells. In some embodiments, the compound is bispecific TCE that is administered in an inactive form and that is activated at and/or within tumor site. In some embodiments, a bispecific TCE is administered before a checkpoint inhibitor therapy begins, concurrently with checkpoint inhibitor therapy, or after checkpoint inhibitor has ended.

Certain aspects of the present disclosure are directed to a chimeric polypeptide comprising a bispecific antibody domain, wherein the bispecific antibody domain comprises a first antigen binding domain that specifically binds to prostate-specific membrane antigen (PSMA) and a second antigen binding domain that binds to cluster of differentiation 3 T cell receptor (CD3), wherein the first antigen binding domain is a VHH; or the second antigen binding domain is a Fab or an scFV, and wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or PSMA, and wherein the protease-cleavable release segment is cleavable by at least one protease that is present in a tumor.

Certain aspects of the present disclosure are directed to a chimeric polypeptide comprising a bispecific antibody domain, wherein the bispecific antibody domain comprises a first antigen binding domain that specifically binds to prostate-specific membrane antigen (PSMA) and a second antigen binding domain that binds to cluster of differentiation 3 T cell receptor (CD3), wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or PSMA, wherein the protease-cleavable release segment is not capable of being cleaved by legumain in human plasma, or wherein legumain cleaves the protease-cleavable release segment in human plasma at a rate that is less than about 25% of the rate that RSR-2295 (EAGRSANHTPAGLTGP) (SEQ ID NO:7048) is cleaved by legumain.

In some embodiments, the chimeric polypeptide comprises a structural arrangement from the N-terminal side to the C-terminal side defined as: (first antigen binding domain)-(second antigen binding domain)-(linker)-(mask polypeptide), (second antigen binding domain)-(first antigen binding domain)-(linker)-(mask polypeptide), (mask polypeptide)-(linker)-(first antigen binding domain)-(second antigen binding domain), or (mask polypeptide)-(linker)-(second antigen binding domain)-(first antigen binding domain), wherein each—is a covalent connection or a polypeptide linker.

In some embodiments, the mask polypeptide is an ELNN.

In some embodiments, the linker further comprises a spacer.

In some embodiments, the protease-cleavable release segment is fused to the bispecific antibody domain via the spacer.

In some embodiments, the spacer is characterized in that: (i) at least 90% of its amino acids are glycine (G), alanine (A), serine (S), threonine (T), glutamate (E), proline (P), or any combination thereof; and (ii) it comprises at least 3 types of amino acids selected from the group consisting of G, A, S, T, E, and P.

In some embodiments, the spacer is from 9 to 14 amino acids in length.

In some embodiments, the spacer comprises at least 4 types of amino acids selected from the group consisting of G, A, S, T, E, and P. In some embodiments, the amino acids of the spacer consist of A, E, G, S, P, and/or T.

In some embodiments, the spacer is cleavable by a non-mammalian protease. In some embodiments, the non-mammalian protease is Glu-C.

In some embodiments, the spacer comprises an amino acid sequence having at least 85%, 90%, 91%, 92%, 93%, 94%, 95%, 96%, 97%, 98%, or 99% identity, or 100% identity, to a sequence listed in Table C. In some embodiments, the spacer comprises an amino acid sequence having at least 85% identity to a sequence listed in Table C. In some embodiments, the spacer comprises an amino acid sequence having at least 90% identity to a sequence listed in Table C. In some embodiments, the spacer comprises an amino acid sequence having at least 91% identity to a sequence listed in Table C. In some embodiments, the spacer comprises an amino acid sequence having at least 92% identity to a sequence listed in Table C. In some embodiments, the spacer comprises an amino acid sequence having at least 93% identity to a sequence listed in Table C. In some embodiments, the spacer comprises an amino acid sequence having at least 94% identity to a sequence listed in Table C. In some embodiments, the spacer comprises an amino acid sequence having at least 95% identity to a sequence listed in Table C. In some embodiments, the spacer comprises an amino acid sequence having at least 96% identity to a sequence listed in Table C. In some embodiments, the spacer comprises an amino acid sequence having at least 97% identity to a sequence listed in Table C. In some embodiments, the spacer comprises an amino acid sequence having at least 98% identity to a sequence listed in Table C. In some embodiments, the spacer comprises an amino acid sequence having at least 99% identity to a sequence listed in Table C. In some embodiments, the spacer comprises an amino acid sequence having 100% identity to a sequence listed in Table C.

In some embodiments, the spacer comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTATPESGPG (SEQ ID NO:97). In some embodiments, the spacer comprises an amino acid sequence that has at least 85% identity to GTSESATPES (SEQ ID NO:96) or GTATPESGPG (SEQ ID NO:97). In some embodiments, the spacer comprises an amino acid sequence that has at least 90% identity to GTSESATPES (SEQ ID NO:96) or GTATPESGPG (SEQ ID NO:97). In some embodiments, the spacer comprises an amino acid sequence that has at least 91% identity to GTSESATPES (SEQ ID NO:96) or GTATPESGPG (SEQ ID NO:97). In some embodiments, the spacer comprises an amino acid sequence that has at least 92% identity to GTSESATPES (SEQ ID NO:96) or GTATPESGPG (SEQ ID NO:97). In some embodiments, the spacer comprises an amino acid sequence that has at least 93% identity to GTSESATPES (SEQ ID NO:96) or GTATPESGPG (SEQ ID NO:97). In some embodiments, the spacer comprises an amino acid sequence that has at least 94% identity to GTSESATPES (SEQ ID NO:96) or GTATPESGPG (SEQ ID NO:97). In some embodiments, the spacer comprises an amino acid sequence that has at least 94% identity to GTSESATPES (SEQ ID NO:96) or GTATPESGPG (SEQ ID NO:97). In some embodiments, the spacer comprises an amino acid sequence that has at least 95% identity to GTSESATPES (SEQ ID NO:96) or GTATPESGPG (SEQ ID NO:97). In some embodiments, the spacer comprises an amino acid sequence that has at least 96% identity to GTSESATPES (SEQ ID NO:96) or GTATPESGPG (SEQ ID NO:97). In some embodiments, the spacer comprises an amino acid sequence that has at least 97% identity to GTSESATPES (SEQ ID NO:96) or GTATPESGPG (SEQ ID NO:97). In some embodiments, the spacer comprises an amino acid sequence that has at least 98% identity to GTSESATPES (SEQ ID NO:96) or GTATPESGPG (SEQ ID NO:97). In some embodiments, the spacer comprises an amino acid sequence that has at least 99% identity to GTSESATPES (SEQ ID NO:96) or GTATPESGPG (SEQ ID NO:97). In some embodiments, the spacer comprises an amino acid sequence that has 100% identity to GTSESATPES (SEQ ID NO:96) or GTATPESGPG (SEQ ID NO:97).

In some embodiments, the protease-cleavable release segment comprises an amino acid sequence comprising the sequence: EAGRSAXHTPAGLTGP (SEQ ID NO: 7627), wherein X is any amino acid other than N. In some embodiments, X is S.

Certain aspects of the present disclosure are directed to a chimeric polypeptide comprising a bispecific antibody domain, wherein the bispecific antibody domain comprises a first antigen binding domain that has binding specificity to a cancer cell antigen, and a second antigen binding domain that has binding specificity to an effector cell antigen expressed on an effector cell, wherein the chimeric polypeptide further comprises a first ELNN joined to the first antigen binding domain via a first linker comprising a first protease-cleavable release segment (RS1) positioned between the first ELNN and the first antigen binding domain such that the first ELNN is capable of reducing the binding of the first antigen binding domain to the cancer cell antigen, wherein the RS1 is cleavable by at least one protease that is present in a tumor, wherein the chimeric polypeptide further comprises a second ELNN joined to the second antigen binding domain via a second linker comprising second protease-cleavable release segment (RS2) positioned between the second ELNN and the second antigen binding domain such that the second ELNN is capable of reducing the binding of the first antigen binding domain to the effector cell antigen, wherein the RS2 is cleavable by at least one protease that is present in a tumor, wherein the first ELNN has a shorter amino acid sequence than the second ELNN, and wherein the cancer cell antigen is not HER2.

In some embodiments, the chimeric polypeptide comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

In some embodiments, each—is a covalent bond. In some embodiments, each—is a peptide bond.

In some embodiments, Linker1 further comprises a first spacer (Spacer1). In some embodiments, Linker2 further comprises a second spacer (Spacer2).

In some embodiments, RS1 is fused to the bispecific antibody domain via Spacer1 and/or RS2 is fused to the bispecific antibody domain via Spacer2.

In some embodiments, the chimeric polypeptide comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS2)-(Spacer2)-(first antigen binding domain)-(second antigen binding domain)-(Spacer1)-(RS1)-(ELNN1), or (ELNN2)-(RS2)-(Spacer2)-(second antigen binding domain)-(first antigen binding domain)-(Spacer1)-(RS1)-(ELNN1), wherein each—is a, individually, covalent bond or a polypeptide linker.

In some embodiments, each—is a covalent bond. In some embodiments, each—is a peptide bond.

In some embodiments, the chimeric polypeptide further comprises an antibody domain linker between the first antigen binding domain and the second antigen binding domain.

Certain aspects of the present disclosure are directed to a chimeric polypeptide comprising a bispecific antibody domain, comprising the formulas that comprises from the N-terminal side to the C-terminal side: Formula 1: (Mask1)-(RS1)-(Spacer1)-(first antigen binding domain)-[antibody domain linker]-(second antigen binding domain); Formula 2: (first antigen binding domain)-[antibody domain linker]-(second antigen binding domain)-(Spacer2)-(RS2)-(Mask2); or Formula 3:(Mask1)-(RS1)-(Spacer1)-(first antigen binding domain)-[antibody domain linker]-(second antigen binding domain)-(Spacer2)-(RS2)-(Mask2), wherein, the first antigen binding domain has binding specificity to a cancer cell antigen; the second antigen binding domain has binding specificity to an effector cell antigen expressed on an effector cell; each—comprises, individually, a covalent connection or a polypeptide linker; the Mask1 is a polypeptide that is capable of reducing binding of the first antigen binding domain to its target; the Mask2 is a polypeptide that is capable of reducing binding of the second antigen binding domain to its target; if the chimeric polypeptide comprises Formula 1 then the Spacer1 consists of A, E, G, S, P, and/or T residues, if the chimeric polypeptide comprises Formula 2 then the Spacer2 consists of A, E, G, S, P, and/or T residues, and if the chimeric polypeptide comprises Formula 3 then the Spacer1 and/or the Spacer2 consists of A, E, G, S, P, and/or T residues; and wherein the cancer cell antigen is not HER2.

In some embodiments, each—is, individually, a covalent connection. In some embodiments, each—is, individually, a covalent bond. In some embodiments, each—is a peptide bond. In some embodiments, each—is, individually, a polypeptide linker of no more than 5 amino acids.

In some embodiments, the cancer cell antigen is human alpha 4 integrin, Ang2, B7-H3, B7-H6, CEACAM5, cMET, CTLA4, FOLR1, EpCAM, CCR5, CD19, HER3, HER4, PD-L1, prostate-specific membrane antigen (PSMA), CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Müellerian inhibitory substance receptor type II (MISIIR), sialylated Tn antigen (sTN), fibroblast activation antigen (FAP), endosialin (CD248), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, or EphA2. In some embodiments, the cancer cell antigen is PSMA.

In some embodiments, the effector cell antigen is cluster of differentiation 3 T cell receptor (CD3).

In some embodiments, the second antigen binding domain has binding specificity to human CD3 and cynomolgus monkey CD3.

In some embodiments, the second antigen binding domain has binding specificity to human CD3.

In some embodiments, the effector cell antigen is CD3 epsilon, CD3 delta, CD3 gamma, or CD3 zeta.

In some embodiments, the effector cell antigen is CD3 epsilon.

In some embodiments, Mask1 is a first ELNN and the Mask2 is a second ELNN.

In some embodiments, the Spacer1 and/or the Spacer2 is characterized in that: (i) at least 90% of its amino acids are glycine (G), alanine (A), serine (S), threonine (T), glutamate (E), proline (P), or any combination thereof; and (ii) it comprises at least 3 types of amino acids selected from the group consisting of G, A, S, T, E, and P.

In some embodiments, the Spacer1 and/or the Spacer2 is from 9 to 14 amino acids in length.

In some embodiments, the Spacer1 and/or the Spacer2 comprises at least 4 types of amino acids selected from the group consisting of G, A, S, T, E, and P.

In some embodiments, the amino acids of the Spacer1 and/or the Spacer2 consists of A, E, G, S, P, and/or T.

In some embodiments, the Spacer1 and/or the Spacer2 is cleavable by a non-mammalian protease. In some embodiments, the non-mammalian protease is Glu-C.

The some embodiments, wherein the Spacer1 and/or the Spacer 2 comprises an amino acid sequence having at least 85%, 90%, 91%, 92%, 93%, 94%, 95%, 96%, 97%, 98%, or 99% identity, or 100% identity, to a sequence listed in Table C. In some embodiments, the Spacer1 and/or the Spacer 2 comprises an amino acid sequence having at least 85% identity to a sequence listed in Table C. In some embodiments, the Spacer1 and/or the Spacer 2 comprises an amino acid sequence having at least 90% identity to a sequence listed in Table C. In some embodiments, the Spacer1 and/or the Spacer 2 comprises an amino acid sequence having at least 91% identity to a sequence listed in Table C. In some embodiments, the Spacer1 and/or the Spacer 2 comprises an amino acid sequence having at least 92% identity to a sequence listed in Table C. In some embodiments, the Spacer1 and/or the Spacer 2 comprises an amino acid sequence having at least 93% identity to a sequence listed in Table C. In some embodiments, the Spacer1 and/or the Spacer 2 comprises an amino acid sequence having at least 94% identity to a sequence listed in Table C. In some embodiments, the Spacer1 and/or the Spacer 2 comprises an amino acid sequence having at least 95% identity to a sequence listed in Table C. In some embodiments, the Spacer1 and/or the Spacer 2 comprises an amino acid sequence having at least 96% identity to a sequence listed in Table C. In some embodiments, the Spacer1 and/or the Spacer 2 comprises an amino acid sequence having at least 97% identity to a sequence listed in Table C. In some embodiments, the Spacer1 and/or the Spacer 2 comprises an amino acid sequence having at least 98% identity to a sequence listed in Table C. In some embodiments, the Spacer1 and/or the Spacer 2 comprises an amino acid sequence having at least 99% identity to a sequence listed in Table C. In some embodiments, the Spacer1 and/or the Spacer 2 comprises an amino acid sequence having 100% identity to a sequence listed in Table C.

In some embodiments, wherein the Spacer1 and/or the Spacer 2 comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTATPESGPG (SEQ ID NO:97). In some embodiments, the Spacer1 and/or the Spacer 2 comprises an amino acid sequence that has at least 85% identity to GTSESATPES (SEQ ID NO:96) or GTATPESGPG (SEQ ID NO:97). In some embodiments, the Spacer1 and/or the Spacer 2 comprises an amino acid sequence that has at least 90% identity to GTSESATPES (SEQ ID NO:96) or GTATPESGPG (SEQ ID NO:97). In some embodiments, the Spacer1 and/or the Spacer 2 comprises an amino acid sequence that has at least 91% identity to GTSESATPES (SEQ ID NO:96) or GTATPESGPG (SEQ ID NO:97). In some embodiments, the Spacer1 and/or the Spacer 2 comprises an amino acid sequence that has at least 92% identity to GTSESATPES (SEQ ID NO:96) or GTATPESGPG (SEQ ID NO:97). In some embodiments, the Spacer1 and/or the Spacer 2 comprises an amino acid sequence that has at least 93% identity to GTSESATPES (SEQ ID NO:96) or GTATPESGPG (SEQ ID NO:97). In some embodiments, the Spacer1 and/or the Spacer 2 comprises an amino acid sequence that has at least 94% identity to GTSESATPES (SEQ ID NO:96) or GTATPESGPG (SEQ ID NO:97). In some embodiments, the Spacer1 and/or the Spacer 2 comprises an amino acid sequence that has at least 94% identity to GTSESATPES (SEQ ID NO:96) or GTATPESGPG (SEQ ID NO:97). In some embodiments, the Spacer1 and/or the Spacer 2 comprises an amino acid sequence that has at least 95% identity to GTSESATPES (SEQ ID NO:96) or GTATPESGPG (SEQ ID NO:97). In some embodiments, the Spacer1 and/or the Spacer 2 comprises an amino acid sequence that has at least 96% identity to GTSESATPES (SEQ ID NO:96) or GTATPESGPG (SEQ ID NO:97). In some embodiments, the Spacer1 and/or the Spacer 2 comprises an amino acid sequence that has at least 97% identity to GTSESATPES (SEQ ID NO:96) or GTATPESGPG (SEQ ID NO:97). In some embodiments, the Spacer1 and/or the Spacer2 comprises an amino acid sequence that has at least 98% identity to GTSESATPES (SEQ ID NO:96) or GTATPESGPG (SEQ ID NO:97). In some embodiments, the Spacer1 and/or the Spacer 2 comprises an amino acid sequence that has at least 99% identity to GTSESATPES (SEQ ID NO:96) or GTATPESGPG (SEQ ID NO:97). In some embodiments, the Spacer1 and/or the Spacer 2 comprises an amino acid sequence that has 100% identity to GTSESATPES (SEQ ID NO:96) or GTATPESGPG (SEQ ID NO:97).

In some embodiments, the amino acid sequence of the first ELNN is at least 100 amino acids shorter than the amino acid sequence of the second ELNN. In some embodiments, the amino acid sequence of the first ELNN is at least 200 amino acids shorter than the amino acid sequence of the second ELNN. In some embodiments, the amino acid sequence of the first ELNN is at least 250 amino acids shorter than the amino acid sequence of the second ELNN. In some embodiments, the amino acid sequence of the first ELNN is about 294 amino acids in length, and wherein the amino acid sequence of the second ELNN is about 582 amino acids in length.

In some embodiments, the first antigen binding domain comprises a first antibody or an antigen-binding fragment thereof, and wherein the second antigen binding domain is a second antibody or an antigen-binding fragment thereof.

In some embodiments, the first antigen binding domain is a Fab, an scFV, or an ISVD. In some embodiments, the ISVD is a VHH domain. In some embodiments, the second antigen binding domain is a Fab, an scFV, or an ISVD. In some embodiments, the ISVD is a VHH domain. In some embodiments, the first antigen binding domain is a VHH domain. In some embodiments, the second antigen binding domain is an scFV.

In some embodiments, there is an antibody domain linker between the first antigen binding domain and the second antigen binding domain.

In some embodiments, the antibody domain linker comprises an amino acid sequence having at least 85%, 90%, 91%, 92%, 93%, 94%, 95%, 96%, 97%, 98%, or 99% identity, or 100% identity, to a sequence listed in Table A or B. In some embodiments, the antibody domain linker comprises an amino acid sequence that has at least 85% identity to a sequence listed in Table A or B. In some embodiments, the antibody domain linker comprises an amino acid sequence that has at least 90% identity to a sequence listed in Table A or B. In some embodiments, the antibody domain linker comprises an amino acid sequence that has at least 91% identity to a sequence listed in Table A or B. In some embodiments, the antibody domain linker comprises an amino acid sequence that has at least 92% identity to a sequence listed in Table A or B. In some embodiments, the antibody domain linker comprises an amino acid sequence that has at least 93% identity to a sequence listed in Table A or B. In some embodiments, the antibody domain linker comprises an amino acid sequence that has at least 94% identity to a sequence listed in Table A or B. In some embodiments, the antibody domain linker comprises an amino acid sequence that has at least 94% identity to a sequence listed in Table A or B. In some embodiments, the antibody domain linker comprises an amino acid sequence that has at least 95% identity to a sequence listed in Table A or B. In some embodiments, the antibody domain linker comprises an amino acid sequence that has at least 96% identity to a sequence listed in Table A or B. In some embodiments, the antibody domain linker comprises an amino acid sequence that has at least 97% identity to a sequence listed in Table A or B. In some embodiments, the antibody domain linker comprises an amino acid sequence that has at least 98% identity to a sequence listed in Table A or B. In some embodiments, the antibody domain linker comprises an amino acid sequence that has at least 99% identity to a sequence listed in Table A or B. In some embodiments, the antibody domain linker comprises an amino acid sequence that has 100% identity to a sequence listed in Table A or B.

In some embodiments, the antibody domain linker consists of G and S amino residues. In some embodiments, the antibody domain linker is about 9 residues in length. In some embodiments, the antibody domain linker comprises the amino acid sequence GGGGSGGGS (SEQ ID NO:125).

In some embodiments, the scFv comprises a VL domain, a VH domain, and a linker between the VL domain and the VH domain, wherein the linker consists of A, E, G, S, P, and/or T residues.

In some embodiments, the linker is characterized in that: (i) at least 90% of its amino acids are glycine (G), alanine (A), serine (S), threonine (T), glutamate (E), proline (P), or any combination thereof; and (ii) it comprises at least 3 types of amino acids selected from the group consisting of G, A, S, T, E, and P.

In some embodiments, the linker between the VL domain and the VH domain is from 25 to 35 amino acids in length.

In some embodiments, the linker between the VL domain and the VH domain comprises at least 4 types of amino acids selected from the group consisting of G, A, S, T, E, and P.

In some embodiments, the amino acids of the linker between the VL domain and the VH domain consists of A, E, G, S, P, and/or T.

In some embodiments, the linker between the VL domain and the VH domain is cleavable by a non-mammalian protease. In some embodiments, the non-mammalian protease is Glu-C.

In some embodiments, the linker between the VL domain and the VH domain comprises an amino acid sequence that has at least 85%, 90%, 91%, 92%, 93%, 94%, 95%, 96%, 97%, 98%, or 99% identity, or 100% identity, to SESATPESGPGTSPGATPESGPGTSESATP (SEQ ID NO: 81).

In some embodiments, the linker between the VL domain and the VH domain comprises an amino acid sequence that has at least 85% identity to SESATPESGPGTSPGATPESGPGTSESATP (SEQ ID NO: 81). In some embodiments, the linker between the VL domain and the VH domain comprises an amino acid sequence that has at least 90% identity to SESATPESGPGTSPGATPESGPGTSESATP (SEQ ID NO: 81). In some embodiments, the linker between the VL domain and the VH domain comprises an amino acid sequence that has at least 91% identity to SESATPESGPGTSPGATPESGPGTSESATP (SEQ ID NO: 81). In some embodiments, the linker between the VL domain and the VH domain comprises an amino acid sequence that has at least 92% identity to SESATPESGPGTSPGATPESGPGTSESATP (SEQ ID NO: 81). In some embodiments, the linker between the VL domain and the VH domain comprises an amino acid sequence that has at least 93% identity to SESATPESGPGTSPGATPESGPGTSESATP (SEQ ID NO: 81). In some embodiments, the linker between the VL domain and the VH domain comprises an amino acid sequence that has at least 94% identity to SESATPESGPGTSPGATPESGPGTSESATP (SEQ ID NO: 81). In some embodiments, the linker between the VL domain and the VH domain comprises an amino acid sequence that has at least 95% identity to SESATPESGPGTSPGATPESGPGTSESATP (SEQ ID NO: 81). In some embodiments, the linker between the VL domain and the VH domain comprises an amino acid sequence that has at least 96% identity to SESATPESGPGTSPGATPESGPGTSESATP (SEQ ID NO: 81). In some embodiments, the linker between the VL domain and the VH domain comprises an amino acid sequence that has at least 97% identity to SESATPESGPGTSPGATPESGPGTSESATP (SEQ ID NO: 81). In some embodiments, the linker between the VL domain and the VH domain comprises an amino acid sequence that has at least 98% identity to SESATPESGPGTSPGATPESGPGTSESATP (SEQ ID NO: 81). In some embodiments, the linker between the VL domain and the VH domain comprises an amino acid sequence that has at least 99% identity to SESATPESGPGTSPGATPESGPGTSESATP (SEQ ID NO: 81). In some embodiments, the linker between the VL domain and the VH domain comprises an amino acid sequence that has 100% identity to SESATPESGPGTSPGATPESGPGTSESATP (SEQ ID NO: 81).

In some embodiments, the first antigen binding domain comprises a VHH domain comprising three VHH complementarity determining regions (CDRs), wherein the three VHH CDRs comprise the CDR1, CDR2, and CDR3 of a VHH domain comprising the following amino acid sequence:

```
                                         (SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.
```

In some embodiments, the second antigen binding domain comprises a VL domain comprising three the VL CDRs, wherein the three VL CDRs comprise the CDR1, CDR2, and CDR3 of a VL domain comprising the following amino acid sequence:

```
                                        (SEQ ID NO: 9001)
ELVVTQEPSLTVSPGGTVTLTCRSSX₁GAVTX₂SNYANWVQQKPGQAPR

GLIGGTNKRAPGTPARFSGSLLGGKAALTLSGVQPEDEAX₃YYCALWYX₄

NLWVFGGGTKLTVL,
``` wherein $X_1$ corresponds to T or N, $X_2$ corresponds to T or S, $X_3$ corresponds to E or V, and $X_4$ corresponds to S or P.

In some embodiments, the second antigen binding domain comprises a VL domain comprising three the VL CDRs, wherein the three VL CDRs comprise the CDR1, CDR2, and CDR3 of a VL domain comprising the following amino acid sequence:

```
                                         (SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL.
```

In some embodiments, the second antigen binding domain comprises a VH domain comprising three the VH CDRs, wherein the three VH CDRs comprise the CDR1, CDR2, and CDR3 of a VH domain comprising the following amino acid sequence: EVQLX₅ESGGGX₆V-QPGGSLX₇LSCAASGFTFX₈TYAMNWVRQAPGK-GLEWVX₉RIRX₁₀KX₁₁NN YATYYADSVKX₁₂RFTISRDDSKN- TX$_{13}$YLQMNX$_{14}$LKTEDTAVYYCVRHX$_{15}$SNFGN-
SYVSWFAX$_{16}$WGQGTLVTVSS (SEQ ID NO:9002),
wherein X$_5$ corresponds to V or L, X$_6$ corresponds to I or L,
X$_7$ corresponds to R or K, X$_8$ corresponds to S or N, X$_9$
corresponds to G or A, X$_{10}$ corresponds to T or S, X$_{11}$
corresponds to R or Y, X$_{12}$ corresponds to G or D, X$_{13}$
corresponds to V or A, X$_{14}$ corresponds to S or N, X$_{15}$
corresponds to E or G, and X$_{16}$ corresponds to H or Y.

In some embodiments, the second antigen binding domain comprises a VH domain comprising three the VH CDRs, wherein the three VH CDRs comprise the CDR1, CDR2, and CDR3 of a VH domain comprising the following amino acid sequence:

(SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS.

In some embodiments, the second antigen binding domain comprises a VL domain amino acid sequence SEQ ID NO/VH domain amino acid sequence SEQ ID NO pair selected from the group consisting of: 896/897; 902/903; 700/701; 702/703; 716/717; 718/719; 728/729; 736/737; 738/739; 740/741; 742/743; 744/745; 746/747; 748/749; 750/751; 752/753; 754/755; 756/757; 758/759; 760/761; 762/763; 764/765; 766/767; 774/775; 776/777; 790/791; 792/793; 798/799; 800/801; 806/807; 808/809; 814/815; 816/817; 822/823; 824/825; or 826/867.

In some embodiments, (i) the first antigen binding domain is a VHH comprising the following CDRs: a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH CDR2 with an amino acid sequence that that has at least 85%, 90%, 91%, 92%, 93%, 94%, 95%, 96%, 97%, 98%, or 99% identity, or 100% identity, to AMSWSGSNRKVSDSVKG (SEQ ID NO:9004); and a VHH CDR3 with an amino acid sequence that has at least 85%, 90%, 91%, 92%, 93%, 94%, 95%, 96%, 97%, 98%, or 99% identity, or 100% identity, to AASN-KEYGRTWYDFNESDY (SEQ ID NO:9005), and (ii) wherein the second antigen binding domain comprises the following CDRs: a VL domain CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:9006), wherein X$_1$ corresponds to T or N, and X$_2$ corresponds to T or S; a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:9007), wherein X$_4$ corresponds to S or P; a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:9008), wherein X$_8$ corresponds to S or N; a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NNYATYYADSVKX$_{12}$ (SEQ ID NO:9009), wherein X$_{10}$ corresponds to T or S, X$_{11}$ corresponds to R or Y, and X$_{12}$ corresponds to G or D; a VH domain CDR3 with an amino acid sequence that has at least 85%, 90%, 91%, 92%, 93%, 94%, 95%, 96%, 97%, 98%, or 99% identity, or 100% identity, to HX$_{15}$NFGNSYVSWFAX$_{16}$ (SEQ ID NO:9010), wherein X$_{15}$ corresponds to E or G, and X$_{16}$ corresponds to H or Y.

In some embodiments, (i) the first antigen binding domain is a VHH comprising the following CDRs: a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH CDR2 with an amino acid sequence that that has at least 85%, 90%, 91%, 92%, 93%, 94%, 95%, 96%, 97%, 98%, or 99% identity, or 100% identity, to AMSWSGSNRKVSDSVKG (SEQ ID NO:9004); and a VHH CDR3 with an amino acid sequence that has at least 85%, 90%, 91%, 92%, 93%, 94%, 95%, 96%, 97%, 98%, or 99% identity, or 100% identity, to AASN-KEYGRTWYDFNESDY (SEQ ID NO:9005), and (ii) wherein the second antigen binding domain comprises the following CDRs: a VL domain CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1); a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6); a VH domain CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12); a VH domain CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and a VH domain CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO:10).

In some embodiments, the VHH comprises the following framework regions (FRs): a VHH FR1 with an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS (SEQ ID NO:9011); a VHH FR2 with an amino acid sequence that has at least 85%, 90%, 91%, 92%, 93%, 94%, 95%, 96%, 97%, 98%, or 99% identity, or 100% identity, to WFRQAPGK-EREFVG (SEQ ID NO:9012); a VHH FR3 with an amino acid sequence that has at least 85%, 90%, 91%, 92%, 93%, 94%, 95%, 96%, 97%, 98%, or 99% identity, or 100% identity, to RFTISRDNSKNTLYLQMNSLRAEDTAVYYC (SEQ ID NO:9013); and a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

In some embodiments, the second antigen binding domain comprises the following FRs: a VL domain FR1 with an amino acid sequence that has at least 85%, 90%, 91%, 92%, 93%, 94%, 95%, 96%, 97%, 98%, or 99% identity, or 100% identity, to ELVVTQEPSLTVSPGGTVTLTC (SEQ ID NO:51); a VL domain FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52); a VL domain FR3 with an amino acid sequence that has at least 85%, 90%, 91%, 92%, 93%, 94%, 95%, 96%, 97%, 98%, or 99% identity, or 100% identity, to GTPARFSGSLLGG-KAALTLSGVQPEDEAVYYC (SEQ ID NO:53); a VL domain FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59); a VH domain FR1 with an amino acid sequence that has at least 85%, 90%, 91%, 92%, 93%, 94%, 95%, 96%, 97%, 98%, or 99% identity, or 100% identity, to EVQLVESGGGIVQPGGSLRLSCAAS (SEQ ID NO:400); a VH domain FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401); a VH domain FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and a VH domain FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, (i) the first antigen binding domain is a VHH comprising the following CDRs: a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH CDR2 with an amino acid sequence that that has at least 85%, 90%, 91%, 92%, 93%, 94%, 95%, 96%, 97%, 98%, or 99% identity, or 100% identity, to AMSWSGSNRK (SEQ ID NO:9015); and a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005), and (ii) wherein the second antigen binding domain comprises the following CDRs: a VL domain CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:9006), wherein X$_1$ corresponds to T or N, and X$_2$ corresponds to T or S; a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:9007), wherein X$_4$ corresponds to S or P; a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:9008), wherein X$_8$ corresponds to S or N; a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NNYATYYADSVKX$_{12}$ (SEQ ID NO:9009), wherein X$_{10}$ corresponds to T or S, X$_{11}$ corresponds to R or Y, and X$_{12}$ corresponds to G or D; a VH domain CDR3 with an amino acid sequence that has at least 85%, 90%, 91%, 92%, 93%, 94%, 95%, 96%, 97%, 98%, or 99% identity, or 100% identity, to HX$_{15}$NFGNSYVSWFAX$_{16}$ (SEQ ID NO:9010), wherein X$_{15}$ corresponds to E or G, and X$_{16}$ corresponds to H or Y.

In some embodiments, (i) the first antigen binding domain is a VHH comprising the following CDRs: a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH CDR2 with an amino acid sequence that has at least 85%, 90%, 91%, 92%, 93%, 94%, 95%, 96%, 97%, 98%, or 99% identity, or 100% identity, to AMSWSGSNRK (SEQ ID NO:9015); and a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005), and (ii) wherein the second antigen binding domain comprises the following CDRs: a VL domain CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1); a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6); a VH domain CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12); a VH domain CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and a VH domain CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO:10).

In some embodiments, the VHH comprises the following framework regions (FRs): a VHH FR1 with an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS (SEQ ID NO:9011); a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012); a VHH FR3 with an amino acid sequence that has at least 85%, 90%, 91%, 92%, 93%, 94%, 95%, 96%, 97%, 98%, or 99% identity, or 100% identity, to VSDSVKGRFTISRDNSKNTLYLQMNSLRAEDTAVYYC (SEQ ID NO:9016); and a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

In some embodiments, the second antigen binding domain comprises the following FRs: a VL domain FR1 with an amino acid sequence that has at least 85%, 90%, 91%, 92%, 93%, 94%, 95%, 96%, 97%, 98%, or 99% identity, or 100% identity, to ELVVTQEPSLTVSPGGTVTLTC (SEQ ID NO:51); a VL domain FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52); a VL domain FR3 with an amino acid sequence that has at least 85%, 90%, 91%, 92%, 93%, 94%, 95%, 96%, 97%, 98%, or 99% identity, or 100% identity, to GTPARFSGSLLGG-KAALTLSGVQPEDEAVYYC (SEQ ID NO:53); a VL domain FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59); a VH domain FR1 with an amino acid sequence that has at least 85%, 90%, 91%, 92%, 93%, 94%, 95%, 96%, 97%, 98%, or 99% identity, or 100% identity, to EVQLVESGGGIVQPGGSLRLSCAAS (SEQ ID NO:400); a VH domain FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401); a VH domain FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and a VH domain FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, the second antigen binding domain comprises a VL domain comprising an amino acid sequence that has at least 85%, 90%, 91%, 92%, 93%, 94%, 95%, 96%, 97%, 98%, or 99% identity, or 100% identity, to:

(SEQ ID NO: 9001)
ELVVTQEPSLTVSPGGTVTLTCRSSX$_1$GAVTX$_2$SNYANWVQQKPGQAPR

GLIGGTNKRAPGTPARFSGSLLGGKAALTLSGVQPEDEAX$_3$YYCALWYX$_4$

NLWVFGGGTKLTVL, wherein X$_1$ corresponds to T or N, X$_2$ corresponds to T or S, X$_3$ corresponds to E or V, and X$_4$ corresponds to S or P.

In some embodiments, the second antigen binding domain comprises a VL domain comprising an amino acid sequence that has at least 85%, 90%, 91%, 92%, 93%, 94%, 95%, 96%, 97%, 98%, or 99% identity, or 100% identity, to:

(SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL.

In some embodiments, the second antigen binding domain comprises a VH domain comprising an amino acid sequence that has at least 85%, 90%, 91%, 92%, 93%, 94%, 95%, 96%, 97%, 98%, or 99% identity, or 100% identity, to: EVQLX$_5$ESGGGX$_6$VQPGGSLX$_7$LSCAASGFTFX$_8$TY-AMNWVRQAPGKGLEWVX$_9$RIRX$_{10}$KX$_{11}$NN YATYYADSVKX$_{12}$RFTISRDDSKNTX$_{13}$YLQMNX$_{14}$L-KTEDTAVYYCVRHX$_{15}$NFGNSYVSWFAX$_{16}$WGQG-TLVTVSS (SEQ ID NO:9002), wherein X$_5$ corresponds to V or L, X$_6$ corresponds to I or L, X$_7$ corresponds to R or K, X$_8$ corresponds to S or N, X$_9$ corresponds to G or A, X$_{10}$ corresponds to T or S, X$_{11}$ corresponds to R or Y, X$_{12}$ corresponds to G or D, X$_{13}$ corresponds to V or A, X$_{14}$ corresponds to S or N, X$_{15}$ corresponds to E or G, and X$_{16}$ corresponds to H or Y.

In some embodiments, the second antigen binding domain comprises a VH domain comprising an amino acid sequence that has at least 85%, 90%, 91%, 92%, 93%, 94%, 95%, 96%, 97%, 98%, or 99% identity, or 100% identity, to:

(SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS.

In some embodiments, the VL domain is N-terminal to the VH domain. In some embodiments, the VL domain is C-terminal to the VH domain.

In some embodiments, the second antigen binding domain comprises a scFV comprising an amino acid sequence that has at least 85%, 90%, 91%, 92%, 93%, 94%, 95%, 96%, 97%, 98%, or 99% identity, or 100% identity, to:

(SEQ ID NO: 215)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVLSESATPESGPGTSPGATPESGPGTSESATPEVQLVESG

GGIVQPGGSLRLSCAASGFTFSTYAMNWVRQAPGKGLEWVGRIRTKRNN

YATYYADSVKGRFTISRDDSKNTVYLQMNSLKTEDTAVYYCVRHENFGN

SYVSWFAHWGQGTLVTVSS.

In some embodiments, the first antigen binding domain comprises a VHH comprising an amino acid sequence that has at least 85%, 90%, 91%, 92%, 93%, 94%, 95%, 96%, 97%, 98%, or 99% identity, or 100% identity, to the amino acid sequence of PSMA.2, PSMA.3, PSMA.5, PSMA.6, PSMA.262, or PSMA.263.

In some embodiments, the first antigen binding domain comprises a VHH comprising an amino acid sequence that has at least 85%, 90%, 91%, 92%, 93%, 94%, 95%, 96%, 97%, 98%, or 99% identity, or 100% identity, to: QVQLVESGGGVVQPGRSLRLSCAASGRTFGI-YVX$_{17}$GWFRQAPGKEREFVGAX$_{18}$SWSGSNRK VSDSVKGRFTISRDNSKNTLYLQMNSLRAEDTAV-YX$_{19}$CX$_{20}$X$_{21}$SNKX$_{22}$YGRTWYDFNESDYWG QGTQVTVSS (SEQ ID NO:9017), wherein X$_{17}$, X$_{18}$, X$_{19}$, X$_{20}$, X$_{21}$, and X$_6$ each, individually, correspond to any naturally occurring amino acid. In some embodiments, X$_{17}$ corresponds to M or W, X$_{18}$ corresponds to M or I, X$_{19}$ corresponds to F or Y, X$_{20}$ corresponds to A or G, X$_{21}$ corresponds to A or G, and/or X$_{22}$ corresponds to L, W, R, D, E, or G.

In some embodiments, the first antigen binding domain comprises a VHH comprising an amino acid sequence that has at least 85%, 90%, 91%, 92%, 93%, 94%, 95%, 96%, 97%, 98%, or 99% identity, or 100% identity, to:

(SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

In some embodiments, the RS comprises a protease cleavage site is cleavable by at least one protease listed in Table 7.

In some embodiments, the RS comprises an amino acid sequence having at least 85%, 90%, 91%, 92%, 93%, 94%, 95%, 96%, 97%, 98%, or 99% identity, or 100% identity, to a sequence listed in Table 8a. In some embodiments, the RS comprises an amino acid sequence having at least 85% identity to a sequence listed in Table 8a. In some embodiments, the RS comprises an amino acid sequence having at least 90% identity to a sequence listed in Table 8a. In some embodiments, the RS comprises an amino acid sequence having at least 91% identity to a sequence listed in Table 8a. In some embodiments, the RS comprises an amino acid sequence having at least 92% identity to a sequence listed in Table 8a. In some embodiments, the RS comprises an amino acid sequence having at least 93% identity to a sequence listed in Table 8a. In some embodiments, the RS comprises an amino acid sequence having at least 94% identity to a sequence listed in Table 8a. In some embodiments, the RS comprises an amino acid sequence having at least 95% identity to a sequence listed in Table 8a. In some embodiments, the RS comprises an amino acid sequence having at least 96% identity to a sequence listed in Table 8a. In some embodiments, the RS comprises an amino acid sequence having at least 97% identity to a sequence listed in Table 8a. In some embodiments, the RS comprises an amino acid sequence having at least 98% identity to a sequence listed in Table 8a. In some embodiments, the RS comprises an amino acid sequence having at least 99% identity to a sequence listed in Table 8a. In some embodiments, the RS comprises an amino acid sequence having 100% identity to a sequence listed in Table 8a.

In some embodiments, the RS is cleavable by uPA, ST14, MMP2, MMP7, MMP9, and MMP14.

In some embodiments, the RS is not cleavable by legumain. In some embodiments, the RS is not cleavable by legumain in human blood, plasma, or serum. In some embodiments, the RS is not cleavable upon incubation with about 1 nM or less legumain for about 20 hours. In some embodiments, the RS is not cleavable upon incubation with about 1 nM or less legumain for about 20 hours in human blood, plasma, or serum.

In some embodiments, legumain cleaves the RS in human plasma at a rate that is less than about 50% of the rate that RSR-2295 (EAGRSANHTPAGLTGP) (SEQ ID NO:7048) is cleaved by legumain. In some embodiments, legumain cleaves the RS in human plasma at a rate that is less than about 25% of the rate that RSR-2295 (EAGRSANHTPAGLTGP) (SEQ ID NO:7048) is cleaved by legumain. In some embodiments, legumain cleaves the RS in human plasma at a rate that is less than about 10% of the rate that RSR-2295 (EAGRSANHTPAGLTGP) (SEQ ID NO:7048) is cleaved by legumain. In some embodiments, legumain cleaves the RS in human plasma at a rate that is less than about 5% of the rate that RSR-2295 (EAGRSANHTPAGLTGP) (SEQ ID NO:7048) is cleaved by legumain. In some embodiments, legumain cleaves the RS in human plasma at a rate that is less than about 2.5% of the rate that RSR-2295 (EAGRSANHTPAGLTGP) (SEQ ID NO:7048) is cleaved by legumain.

In some embodiments, the RS1 and/or RS2 comprises protease cleavage is cleavable by at least one protease listed in Table 7.

In some embodiments, the RS1 and/or RS2 comprises an amino acid sequence having at least 85%, 90%, 91%, 92%, 93%, 94%, 95%, 96%, 97%, 98%, or 99% identity, or 100% identity, to a sequence listed in Table 8a. In some embodiments, the RS1 and/or RS2 comprises an amino acid sequence having at least 85% identity to a sequence listed in Table 8a. In some embodiments, the RS1 and/or RS2 comprises an amino acid sequence having at least 90% identity to a sequence listed in Table 8a. In some embodiments, the RS1 and/or RS2 comprises an amino acid sequence having at least 91% identity to a sequence listed in Table 8a. In some embodiments, the RS1 and/or RS2 comprises an amino acid sequence having at least 92% identity to a sequence listed in Table 8a. In some embodiments, the RS1 and/or RS2 comprises an amino acid sequence having at least 93% identity to a sequence listed in Table 8a. In some embodiments, the RS1 and/or RS2 comprises an amino acid sequence having at least 94% identity to a sequence listed in Table 8a. In some embodiments, the RS1 and/or RS2 comprises an amino acid sequence having at least 95% identity to a sequence listed in Table 8a. In some embodiments, the RS1 and/or RS2 comprises an amino acid sequence having at least 96% identity to a sequence listed in Table 8a. In some embodiments, the RS1 and/or RS2 comprises an amino acid sequence having at least 97% identity to a sequence listed in Table 8a. In some embodiments, the RS1 and/or RS2 comprises an amino acid sequence having at least 98% identity to a sequence listed in Table 8a. In some embodiments, the RS1 and/or RS2 comprises an amino acid sequence having at least 99% identity to a sequence listed in Table 8a. In some embodiments, the RS1 and/or RS2 comprises an amino acid sequence having 100% identity to a sequence listed in Table 8a.

In some embodiments, the RS1 and/or RS2 is cleavable by uPA, ST14, MMP2, MMP7, MMP9, and MMP14.

In some embodiments, the RS1 and/or RS2 is not cleavable by legumain. In some embodiments, the RS1 and/or RS2 is not cleavable by legumain in human blood, plasma, or serum. In some embodiments, the RS1 and/or RS2 is not cleavable upon incubation with about 1 nM or less legumain for about 20 hours. In some embodiments, the RS1 and/or RS2 is not cleavable upon incubation with about 1 nM or less legumain for about 20 hours in human blood, plasma, or serum.

In some embodiments, legumain cleaves the RS1 and/or RS2 in human plasma at a rate that is less than about 50% of the rate that RSR-2295 (EAGRSANHTPAGLTGP) (SEQ ID NO:7048) is cleaved by legumain. In some embodiments, legumain cleaves the RS1 and/or RS2 in human plasma at a rate that is less than about 25% of the rate that RSR-2295 (EAGRSANHTPAGLTGP) (SEQ ID NO:7048) is cleaved by legumain. In some embodiments, legumain cleaves the RS1 and/or RS2 in human plasma at a rate that is less than about 10% of the rate that RSR-2295 (EAGRSANHTPAGLTGP) (SEQ ID NO:7048) is cleaved by legumain. In some embodiments, legumain cleaves the RS1 and/or RS2 in human plasma at a rate that is less than about 5% of the rate that RSR-2295 (EAGRSANHTPAGLTGP) (SEQ ID NO:7048) is cleaved by legumain. In some embodiments, legumain cleaves the RS1 and/or RS2 in human plasma at a rate that is less than about 2.5% of the rate that RSR-2295 (EAGRSANHTPAGLTGP) (SEQ ID NO:7048) is cleaved by legumain.

In some embodiments, the RS1 comprises a protease-cleavable amino acid sequence comprising the sequence: EAGRSAXHTPAGLTGP (SEQ ID NO: 7627), wherein X is any amino acid other than N.

In some embodiments, the RS2 comprises a protease-cleavable amino acid sequence comprising the sequence: EAGRSAXHTPAGLTGP (SEQ ID NO: 7627), wherein X is any amino acid other than N.

In some embodiments, RS1 and/or RS2 comprises a protease-cleavable amino acid sequence comprising the sequence: EAGRSASHTPAGLTGP (SEQ ID NO: 7628).

In some embodiments, the RS1 and the RS2 are the same. In some embodiments, the RS1 and the RS2 are different.

In some embodiments, the mask polypeptide is a first mask polypeptide and the protease-cleavable release segment is a first protease-cleavable release segment (RS1), and wherein the chimeric polypeptide further comprises a second mask polypeptide and a second protease-cleavable release segment (RS2), wherein the second mask polypeptide is joined to the second antigen binding domain via a second protease-cleavable release segment (RS2) positioned between the second mask polypeptide and the second antigen binding domain such that the second mask polypeptide reduces the binding of the first antigen binding domain to CD3, wherein the RS2 is cleavable by at least one protease that is present in a tumor.

In some embodiments, the first mask polypeptide is attached to the first antigen binding domain and wherein the second mask polypeptide is attached to the second antigen binding domain.

In some embodiments, the first mask polypeptide is a first ELNN and the second mask polypeptide is a second ELNN.

In some embodiments, the first ELNN and the second ELNN are each individually characterized in that: (i) at least 90% of each of the first ELNN's and the second ELNN's amino acids are glycine (G), alanine (A), serine (S), threonine (T), glutamate (E), proline (P), or any combination thereof; and (ii) each comprises at least 3 types of amino acids selected from the group consisting of G, A, S, T, E, and P.

In some embodiments, the first ELNN and the second ELNN are each individually further characterized in that: (i) each comprises at least 100 amino acid residues; and (ii) each comprises a plurality of non-overlapping sequence motifs that are each from 9 to 14 amino acids in length, wherein the plurality of non-overlapping sequence motifs comprise a set of non-overlapping sequence motives, wherein each non-overlapping sequence motive of the set of non-overlapping sequence motifs is repeated at least two times in the ELNN.

In some embodiments, the plurality of non-overlapping sequence motifs comprises at least one non-overlapping sequence motif that occurs only once within the ELNN. In some embodiments, the non-overlapping sequence motifs comprise one of or any combination of the sequence motifs listed in Table 1. In some embodiments, the non-overlapping sequence motifs comprise at least 2, 3, or 4 of the sequence motifs listed in Table 1. In some embodiments, the non-overlapping sequence motifs comprise any one of or any combination of GTSTEPSEGSAP (SEQ ID NO:189), GTSESATPESGP (SEQ ID NO:188), GSGPGTSESATP (SEQ ID NO:9018), GSEPATSGSETP (SEQ ID NO:187), GSPAGSPTSTEE (SEQ ID NO:186), and GTSPSATPESGP (SEQ ID NO:9019).

In some embodiments, each of the first ELNN and the second ELNN comprises at least 4 types of amino acids selected from the group consisting of G, A, S, T, E, and P. In some embodiments, the amino acids of each of the first ELNN and the second ELNN consists of A, E, G, S, P, and/or T.

In some embodiments, the amino acid sequence of the first ELNN is at least 100 amino acids shorter than the amino acid sequence of the second ELNN. In some embodiments, the amino acid sequence of the first ELNN is at least 200 amino acids shorter than the amino acid sequence of the second ELNN. In some embodiments, the amino acid sequence of the first ELNN is at least 250 amino acids shorter than the amino acid sequence of the second ELNN. In some embodiments, the amino acid sequence of the first ELNN is about 294 amino acids in length, and wherein the amino acid sequence of the second ELNN is about 582 amino acids in length.

In some embodiments, the first ELNN and/or the second ELNN comprises an amino acid sequence that is at least 85% identical to an amino acid sequence listed in Table 3a or 3b.

In some embodiments, the first ELNN comprises an amino acid sequence that has at least 85%, 90%, 91%, 92%, 93%, 94%, 95%, 96%, 97%, 98%, or 99% identity, or 100% identity, to: ASSATPESGPGTSTEPSEGSAPGTSESATPESGPGSGPGTSESATPGTSESATPESGPGSEP ATSGSETPGTSESATPESGPGTSTEPSEGSAPGSPAGSPTSTEEGTSESATPESGPGSEPATS GSETPGTSESATPESGPGSPAGSPTSTEEGSPAGSPTSTEEGTSTEPSEGSAPGTSESATPES GPGTSESATPESGPGSEPATSGSETPGSEPATSGSETPGSPAGSPTSTEE GTSTEPSEGSAPGTSTEPSEGSAPGSEPATSGSETPGTSESATP (SEQ ID NO: 8021). In some embodiments, the first ELNN comprises an amino acid sequence that has at least 85%, identity to SEQ ID NO: 8021. In some embodiments, the first ELNN comprises an amino acid sequence that has at least 90%, identity to SEQ ID NO: 8021. In some embodiments, the first ELNN comprises an amino acid sequence that has at least 91%, identity to SEQ ID NO: 8021. In some embodiments, the first ELNN comprises an amino acid sequence that has at least 92%, identity to SEQ ID NO: 8021. In some embodiments, the first ELNN comprises an amino acid sequence that has at least 93%, identity to SEQ ID NO: 8021. In some embodiments, the first ELNN comprises an amino acid sequence that has at least 94%, identity to SEQ ID NO: 8021. In some embodiments, the first ELNN comprises an amino acid sequence that has at least 95%, identity to SEQ ID NO: 8021. In some embodiments, the first ELNN comprises an amino acid sequence that has at least 96%, identity to SEQ ID NO: 8021. In some embodiments, the first ELNN comprises an amino acid sequence that has at least 97%, identity to SEQ ID NO: 8021. In some embodiments, the first ELNN comprises an amino acid sequence that has at least 98%, identity to SEQ ID NO: 8021. In some embodiments, the first ELNN comprises an amino acid sequence that has at least 99%, identity to SEQ ID NO: 8021. In some embodiments, the first ELNN comprises an amino acid sequence that has 100%, identity to SEQ ID NO: 8021.

In some embodiments, the second ELNN comprises an amino acid sequence that has at least 85%, 90%, 91%, 92%, 93%, 94%, 95%, 96%, 97%, 98%, or 99% identity, or 100% identity, to: ATPESGPGTSESATPESGPGSPAGSPTSTEEGTSESATPESGPGSEPATSGSETPGTSESATP ESGPGTSTEPSEGSAPGTSTEPSEGSAPGTSTEPSEGSAPGTSTEPSEGSAPGTSTEPSEGS APGTSTEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPESGPGS PAGSPTSTEEGSPAGSPTSTEEGSPAGSPTSTEEGTSESATPESGPGTSTEPSEGSAPGTSES ATPESGPGSEPATSGSETPGTSESATPESGPGSEPATSGSETPGTSESATPESGPGTSTEPSE GSAPGSPAGSPTSTEEGTSESATPESGPGSEPATSGSETPGTSESATPESGPGSPAGSPTST EEGSPAGSPTSTEEGTSTEPSEGSAPGTSESATPESGPGTSESATPESGPGTSPSATPESGP GSEPATSGSETPGSEPATSGSETPGSPAGSPTSTEEGTSTEPSEGSAPGTSTEPSEGSAPGS EPATSGSETPGTSESAGEPEA (SEQ ID NO: 8022). In some embodiments, the first ELNN comprises an amino acid sequence that has at least 85%, identity to SEQ ID NO: 8022. In some embodiments, the first ELNN comprises an amino acid sequence that has at least 90%, identity to SEQ ID NO: 8022. In some embodiments, the first ELNN comprises an amino acid sequence that has at least 91%, identity to SEQ ID NO: 8022. In some embodiments, the first ELNN comprises an amino acid sequence that has at least 92%, identity to SEQ ID NO: 8022. In some embodiments, the first ELNN comprises an amino acid sequence that has at least 93%, identity to SEQ ID NO: 8022. In some embodiments, the first ELNN comprises an amino acid sequence that has at least 94%, identity to SEQ ID NO: 8022. In some embodiments, the first ELNN comprises an amino acid sequence that has at least 95%, identity to SEQ ID NO: 8022. In some embodiments, the first ELNN comprises an amino acid sequence that has at least 96%, identity to SEQ ID NO: 8022. In some embodiments, the first ELNN comprises an amino acid sequence that has at least 97%, identity to SEQ ID NO: 8022. In some embodiments, the first ELNN comprises an amino acid sequence that has at least 98%, identity to SEQ ID NO: 8022. In some embodiments, the first ELNN comprises an amino acid sequence that has at least 99%, identity to SEQ ID NO: 8022. In some embodiments, the first ELNN comprises an amino acid sequence that has 100%, identity to SEQ ID NO: 8022.

In some embodiments, the chimeric polypeptide comprises one or more barcode fragments. In some embodiments, the chimeric polypeptide comprises two or more barcode fragments. In some embodiments, each barcode fragment is different from every other barcode fragment.

In some embodiments, each barcode fragment differs in both sequence and molecular weight from all other peptide fragments that are releasable from the chimeric polypeptide upon complete digestion the chimeric polypeptide by a non-mammalian protease.

In some embodiments, the non-mammalian protease is Glu-C. In some embodiments, the chimeric polypeptide comprises a Glu-C cleavage site comprising one of the following amino acid sequences: ATPESGPG (SEQ ID NO:9020), SGSETPGT (SEQ ID NO:9021), and GTSESATP (SEQ ID NO:9022).

In some embodiments, the chimeric polypeptide comprises at least one of the following amino acid sequences:
SGPE.SGPGX$_n$SGPE.SGPG (SEQ ID NO:9023),
SGPE.SGPGX$_n$ATPE.SGPG (SEQ ID NO:9024),
SGPE.SGPGX$_n$GTSE.SATP (SEQ ID NO:9025),
SGPE.SGPGX$_n$TTPE.SGPG (SEQ ID NO:9026),
SGPE.SGPGX$_n$STPE.SGPG (SEQ ID NO:9027),
SGPE.SGPGX$_n$GTPE.SGPG (SEQ ID NO:9028),
SGPE.SGPGX$_n$GTPE.TPGS (SEQ ID NO:9029),
SGPE.SGPGX$_n$GTPE.TPGS (SEQ ID NO:9029),
SGPE.SGPGX$_n$SGSE.TGTP (SEQ ID NO:9030),
SGPE.SGPGX$_n$GTPE.GSAP (SEQ ID NO:9031),
SGPE.SGPGX$_n$EPSE.SATP (SEQ ID NO:9032),
ATPE.SGPGX$_n$SGPE.SGPG (SEQ ID NO:9033),
ATPE.SGPGX$_n$ATPE.SGPG (SEQ ID NO:9034),
ATPE.SGPGX$_n$GTSE.SATP (SEQ ID NO:9035),
ATPE.SGPGX$_n$TTPE.SGPG (SEQ ID NO:9036),
ATPE.SGPGX$_n$STPE.SGPG (SEQ ID NO:9037),
ATPE.SGPGX$_n$GTPE.SGPG (SEQ ID NO:9043)ATPE.SGPGX$_n$GTPE.TPGS (SEQ ID NO:9045),
ATPE.SGPGX$_n$SGSE.TGTP (SEQ ID NO:9046),
ATPE.SGPGX$_n$GTPE.GSAP (SEQ ID NO:9047),
ATPE.SGPGX$_n$EPSE.SATP (SEQ ID NO:9048), GTSE.SATPX$_n$SGPE.SGPG (SEQ ID NO:9049), GTSE.SATPX$_n$ATPE.SGPG (SEQ ID NO:9050), GTSE.SATPX$_n$GTSE.SATP (SEQ ID NO:9051), GTSE.SATPX$_n$TTPE.SGPG (SEQ ID NO:9052), GTSE.SATPX$_n$STPE.SGPG (SEQ ID NO:9053), GTSE.SATPX$_n$GTPE.SGPG (SEQ ID NO:9054), GTSE.SATPX$_n$GTPE.TPGS (SEQ ID NO:9055), GTSE.SATPX$_n$SGSE.TGTP (SEQ ID NO:9056), GTSE.SATPX$_n$GTPE.GSAP (SEQ ID NO:9057), GTSE.SATPX$_n$EPSE.SATP (SEQ ID NO:9058),
TTPE.SGPGX$_n$SGPE.SGPG (SEQ ID NO:9059),
TTPE.SGPGX$_n$ATPE.SGPG (SEQ ID NO:9060),
TTPE.SGPGX$_n$GTSE.SATP (SEQ ID NO:9061),
TTPE.SGPGX$_n$TTPE.SGPG (SEQ ID NO:9062),
TTPE.SGPGX$_n$STPE.SGPG (SEQ ID NO:9064),
TTPE.SGPGX$_n$GTPE.SGPG (SEQ ID NO:9065),
TTPE.SGPGX$_n$GTPE.TPGS (SEQ ID NO:9066),
TTPE.SGPGX$_n$SGSE.TGTP (SEQ ID NO:9067),
TTPE.SGPGX$_n$GTPE.GSAP (SEQ ID NO:9068),
TTPE.SGPGX$_n$EPSE.SATP (SEQ ID NO:9069),
STPE.SGPGX$_n$SGPE.SGPG (SEQ ID NO:9070),
STPE.SGPGX$_n$ATPE.SGPG (SEQ ID NO:9071),
STPE.SGPGX$_n$GTSE.SATP (SEQ ID NO:9072),
STPE.SGPGX$_n$TTPE.SGPG (SEQ ID NO:9073),
STPE.SGPGX$_n$STPE.SGPG (SEQ ID NO:9074),
STPE.SGPGX$_n$GTPE.SGPG (SEQ ID NO:9076),
STPE.SGPGX$_n$GTPE.TPGS (SEQ ID NO:9077),
STPE.SGPGX$_n$SGSE.TGTP (SEQ ID NO:9078),
STPE.SGPGX$_n$GTPE.GSAP (SEQ ID NO:9079),
STPE.SGPGX$_n$EPSE.SATP (SEQ ID NO:9080),
GTPE.SGPGX$_n$SGPE.SGPG (SEQ ID NO:9081),
GTPE.SGPGX$_n$ATPE.SGPG (SEQ ID NO:9082),
GTPE.SGPGX$_n$GTSE.SATP (SEQ ID NO:9083),
GTPE.SGPGX$_n$TTPE.SGPG (SEQ ID NO:9084),
GTPE.SGPGX$_n$STPE.SGPG (SEQ ID NO:9086),
GTPE.SGPGX$_n$GTPE.SGPG (SEQ ID NO:9088),
GTPE.SGPGX$_n$GTPE.TPGS (SEQ ID NO:9090),
GTPE.SGPGX$_n$SGSE.TGTP (SEQ ID NO:9091),
GTPE.SGPGX$_n$GTPE.GSAP (SEQ ID NO:9092),
GTPE.SGPGX$_n$EPSE.SATP (SEQ ID NO:9093),
GTPE.TPGSX$_n$SGPE.SGPG (SEQ ID NO:9094),
GTPE.TPGSX$_n$ATPE.SGPG (SEQ ID NO:9095),
GTPE.TPGSX$_n$GTSE.SATP (SEQ ID NO:9096),
GTPE.TPGSX$_n$TTPE.SGPG (SEQ ID NO:9097),
GTPE.TPGSX$_n$STPE.SGPG (SEQ ID NO:9098),
GTPE.TPGSX$_n$GTPE.SGPG (SEQ ID NO:9099),
GTPE.TPGSX$_n$GTPE.TPGS (SEQ ID NO:9100),
GTPE.TPGSX$_n$SGSE.TGTP (SEQ ID NO:9101),
GTPE.TPGSX$_n$GTPE.GSAP (SEQ ID NO:9103),
GTPE.TPGSX$_n$EPSE.SATP (SEQ ID NO:9104),
SGSE.TGTPX$_n$SGPE.SGPG (SEQ ID NO:9105),
SGSE.TGTPX$_n$ATPE.SGPG (SEQ ID NO:9106),
SGSE.TGTPX$_n$GTSE.SATP (SEQ ID NO:9107),
SGSE.TGTPX$_n$TTPE.SGPG (SEQ ID NO:9108),
SGSE.TGTPX$_n$STPE.SGPG (SEQ ID NO:9109),
SGSE.TGTPX$_n$GTPE.SGPG (SEQ ID NO:9110),
SGSE.TGTPX$_n$GTPE.TPGS (SEQ ID NO:9111),
SGSE.TGTPX$_n$SGSE.TGTP (SEQ ID NO:9112),
SGSE.TGTPX$_n$GTPE.GSAP (SEQ ID NO:9113),
SGSE.TGTPX$_n$EPSE.SATP (SEQ ID NO:9114),
GTPE.GSAPX$_n$SGPE.SGPG (SEQ ID NO:9115),
GTPE.GSAPX$_n$ATPE.SGPG (SEQ ID NO:9116),
GTPE.GSAPX$_n$GTSE.SATP (SEQ ID NO:9117),
GTPE.GSAPX$_n$TTPE.SGPG (SEQ ID NO:9118),
GTPE.GSAPX$_n$STPE.SGPG (SEQ ID NO:9119),
GTPE.GSAPX$_n$GTPE.SGPG (SEQ ID NO:9120),
GTPE.GSAPX$_n$GTPE.TPGS (SEQ ID NO:9121),
GTPE.GSAPX$_n$SGSE.TGTP (SEQ ID NO:9122),
GTPE.GSAPX$_n$GTPE.GSAP (SEQ ID NO:9123),
GTPE.GSAPX$_n$EPSE.SATP (SEQ ID NO:9124),
EPSE.SATPX$_n$SGPE.SGPG (SEQ ID NO:9126),
EPSE.SATPX$_n$ATPE.SGPG (SEQ ID NO:9127),
EPSE.SATPX$_n$GTSE.SATP (SEQ ID NO:9128),
EPSE.SATPX$_n$TTPE.SGPG (SEQ ID NO:9129),
EPSE.SATPX$_n$STPE.SGPG (SEQ ID NO:9130),
EPSE.SATPX$_n$GTPE.SGPG (SEQ ID NO:9131),
EPSE.SATPX$_n$GTPE.TPGS (SEQ ID NO:9132),
EPSE.SATPX$_n$SGSE.TGTP (SEQ ID NO:9133),
EPSE.SATPX$_n$GTPE.GSAP (SEQ ID NO:9134), or
EPSE.SATPX$_n$EPSE.SATP (SEQ ID NO:9135), wherein each "." is a Glu-C cleavage site and n is any integer from 0 to 50. In some embodiments, the chimeric polypeptide comprises at least one of the following amino acid sequences:

SGPE.SGPGX$_n$ATPE.SGPG, (SEQ ID NO: 9038)

ATPE.SGPGX$_n$GTSE.SATP, (SEQ ID NO: 9040)

ATPE.SGPGX$_n$TTPE.SGPG, (SEQ ID NO: 9041)

ATPE.SGPGX$_n$STPE.SGPG, (SEQ ID NO: 9042)

ATPE.SGPGX$_n$ATPE.SGPG, (SEQ ID NO: 9039)

ATPE.SGPGX$_n$GTPE.SGPG, (SEQ ID NO: 9044)

ATPE.SGPGX$_n$GTPE.SGPG, (SEQ ID NO: 9044)

ATPE.SGPGX$_n$ATPE.SGPG, (SEQ ID NO: 9039)

GTPE.SGPGX$_n$GTPE.SGPG, (SEQ ID NO: 9089)

GTPE.SGPGX$_n$STPE.SGPG, (SEQ ID NO: 9087)

GTPE.SGPGX$_n$TTPE.SGPG, (SEQ ID NO: 9085)

GTPE.SGPGX$_n$STPE.SGPG, (SEQ ID NO: 9087)

GTPE.TPGSX$_n$SGSE.TGTP, (SEQ ID NO: 9102)

GTPE.GSAPX$_n$EPSE.SATP, (SEQ ID NO: 9125)

ATPE.SGPGX$_n$GTPE.SGPG, (SEQ ID NO: 9044)

ATPE.SGPGX$_n$GTPE.SGPG, (SEQ ID NO: 9044)

ATPE.SGPGX$_n$ATPE.SGPG, (SEQ ID NO: 9039)

ATPE.SGPGX$_n$GTPE.SGPG, (SEQ ID NO: 9044)

TTPE.SGPGX$_n$TTPE.SGPG, or (SEQ ID NO: 9063)

STPE.SGPGX$_n$STPE.SGPG, (SEQ ID NO: 9075)

wherein each "." is a Glu-C cleavage site and n is any integer from 0 to 30.

In some embodiments, n is any integer from 1 to 20. In some embodiments, n is any integer from 5 to 15. In some embodiments, n is any integer from 3 to 7. In some embodiments, n is any integer from 5 to 10. In some embodiments, n is 9. In some embodiments, n is 4.

In some embodiments, X$_n$ is PGTGTSAT (SEQ ID NO:9136), PGSGPGT (SEQ ID NO:9137), PGTTPGTT (SEQ ID NO:9138), PGTPPTST (SEQ ID NO:9139), PGTSPSAT (SEQ ID NO:9140), PGTGSAGT (SEQ ID NO:9141), PGTGGAGT (SEQ ID NO:9142), PGTSPGAT (SEQ ID NO:9143), PGTSGSGT (SEQ ID NO:9144), PGTSSAST (SEQ ID NO:9145), PGTGAGTT (SEQ ID NO:9146), PGTGSTST (SEQ ID NO:9147), GSEPATSG (SEQ ID NO:9148), APGTSTEP (SEQ ID NO:9149), PGTAGSGT (SEQ ID NO:9150), PGTSSGGT (SEQ ID NO:9151), PGTAGPAT (SEQ ID NO:9152), PGTPGTGT (SEQ ID NO:9153), PGTGGPTT (SEQ ID NO:9154), or PGTGSGST (SEQ ID NO:9155).

In some embodiments, X$_n$ is TGTS (SEQ ID NO:9156), SGP, TTPG (SEQ ID NO:9157), TPPT (SEQ ID NO:9158), TSPS (SEQ ID NO:9159), TGSA (SEQ ID NO:9160), TGGA (SEQ ID NO:9161), TSPG (SEQ ID NO:9162), TSGS (SEQ ID NO:9163), TSSA (SEQ ID NO:9164), TGAG (SEQ ID NO:9165), TGST (SEQ ID NO:9166), EPAT (SEQ ID NO:9167), GTST (SEQ ID NO:9168), TAGS (SEQ ID NO:9169), TSSG (SEQ ID NO:9170), TAGP (SEQ ID NO:9171), TPGT (SEQ ID NO:9172), TGGP (SEQ ID NO:9173), or TGSG (SEQ ID NO:9174).

In some embodiments, neither the N-terminal amino acid nor the C-terminal acid of the chimeric polypeptide is included in a barcode fragment.

In some embodiments, the chimeric polypeptide comprises an ELNN with a non-overlapping sequence motif that occurs only once within the ELNN, wherein the ELNN further comprises a barcode fragment that includes at least part of the non-overlapping sequence motif that occurs only once within the ELNN.

In some embodiments, the chimeric polypeptide comprises a first ELNN with a first barcode fragment and a second ELNN with a second barcode fragment, wherein neither the first barcode fragment nor the second barcode fragment includes a glutamate that is immediately adjacent to another glutamate, if present, in the ELNN that contains the barcode fragment.

In some embodiments, at least one of the barcode fragments comprises a glutamate at the C-terminus thereof.

In some embodiments, at least one of the barcode fragments has an N-terminal amino acid that is immediately preceded by a glutamate in the chimeric polypeptide.

In some embodiments, the glutamate that precedes the N-terminal amino acid of the barcode fragment is not immediately adjacent to another glutamate.

In some embodiments, at least one of the barcode fragments does not include a second glutamate at a position other than the C-terminus of the barcode fragment unless the second glutamate is immediately followed by a proline.

In some embodiments, the chimeric polypeptide comprises a single polypeptide chain, wherein the chimeric polypeptide comprises a barcode fragment that is at a position within the polypeptide chain that is from 10 to 200 amino acids or from 10 to 125 amino acids from the N-terminus or the C-terminus of the chimeric polypeptide. In some embodiments, the first ELNN is at the N-terminal side of the bispecific antibody domain, and wherein the first barcode fragment is positioned within 200, 150, 100, or 50 amino acids of the N-terminus of the chimeric polypeptide. In some embodiments, the second ELNN is at the C-terminal side of the bispecific antibody domain, and wherein the second barcode fragment is positioned within 200, 150, 100, or 50 amino acids of the C-terminus of the chimeric polypeptide.

In some embodiments, at least one of the barcode fragments is at least 4 amino acids in length.

In some embodiments, at least one of the barcode fragments is from 4 to 20, from 5 to 15, from 6 to 12, or from 7 to 10 amino acids in length.

In some embodiments, each mask polypeptide comprises one barcode fragment that is listed in Table 2 or disclosed in Table 3a.

In some embodiments, the chimeric polypeptide comprises a barcode fragment comprising an amino acid sequence that has at least 85%, 90%, 91%, 92%, 93%, 94%, 95%, 96%, 97%, 98%, or 99% identity, or 100% identity, to SGPGSGPGTSE (SEQ ID NO:78) or SGPGTSPSATPE (SEQ ID NO:79).

In some embodiments, the chimeric polypeptide comprises one barcode fragment comprising an amino acid sequence that is at least 95% identical to SGPGSGPGTSE (SEQ ID NO:78) and one barcode fragment comprising an amino acid sequence that is at least 95% identical to SGPGTSPSATPE (SEQ ID NO:79).

In some embodiments, the barcode fragment consists of A, E, G, S, P, and/or T residues.

In some embodiments, the barcode fragment is part of a mask peptide.

In some embodiments, the mask peptide is the first ELNN or the second ELNN.

In some embodiments, the chimeric polypeptide comprises an amino acid sequence that has at least 85%, 90%, 91%, 92%, 93%, 94%, 95%, 96%, 97%, 98%, or 99% identity, or 100% identity, to a sequence listed in Table D (SEQ ID NOs: 1000-1009). In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1000. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1001. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1002. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1003. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1004. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1005. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1006. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1007. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1008. In some embodiments, the chimeric polypeptide comprises an amino acid sequence that has at least 85%, 90%, 91%, 92%, 93%, 94%, 95%, 96%, 97%, 98%, or 99% identity, or 100% identity, to SEQ ID NO: 1009.

In some embodiments, the chimeric polypeptide comprises an amino acid sequence that has at least 85%, 90%, 91%, 92%, 93%, 94%, 95%, 96%, 97%, 98%, or 99% identity, or 100% identity, to: ASSATPESGPGT-STEPSEGSAPGTSESATPESGPGSGPGTSESATPGTS-ESATPESGPGSEP ATSGSETPGTSESATPESGPGT-STEPSEGSAPGSPAGSPTSTEEGTSESATPESGPGSEPATS GSETPGTSESATPESGPGSPAGSPTSTEEGSPAGSPT-STEEGTSTEPSEGSAPGTSESATPES GPGTSESAT-PESGPGTSESATPESGPGSEPATSGSETPGSEPATSG-SETPGSPAGSPTSTEE GTSTEPSEGSAPGTSTEPSEGSAPGSEPATSGSETPGT-SESATPEAGRSASHTPAGLTGPGT SESAT-PESQVQLVESGGGVVQPGRSLRLSCAAS-GRTFGIYVWGWFRQAPGKEREFVGAMSW SGSNRKVSDSVKGRFTISRDNSKNTLYLQMNSLRAE-DTAVYYCAASNKEYGRTWYDFNESDY WGQGTQVTVSSGGGGSGGG-SELVVTQEPSLTVSPGGTVTLTCRSSN-GAVTSSNYANWVQQ KPGQAPRGLIGGTNKRAPGT-PARFSGSLLGGKAALTLSGVQPEDEAVYYCALW-YPNLWVFGG GTKLTVLSESATPESGPGTSPGAT-PESGPGTSESATPEVQLVESGGGIVQPGGSLRLS-CAASG FTFSTYAMNWVRQAPGK-GLEWVGRIRTKRNNYATYYADSVKGRFTISRDDS-KNTVYLQMNSL KTEDTAVYYCVRHENFGNSYVSW-FAHWGQGTLVTVSSGTATPESGPGEAGRSASHT-PAGLT GPATPESGPGTSESATPESGPGSPAGSPT-STEEGTSESATPESGPGSEPATSGSETPGTSES ATPESGPGTSTEPSEGSAPGTSTEPSEGSAPGT-STEPSEGSAPGTSTEPSEGSAPGTSTEPSE GSAPGT-STEPSEGSAPGSPAGSPTSTEEGTSTEPSEGSAPGTS-ESATPESGPGSEPATSGSE TPGTSESATPESGPGSEPATSGSETPGTSESAT-PESGPGTSTEPSEGSAPGTSESATPESGP GSPAGSPT-STEEGSPAGSPTSTEEGSPAGSPTSTEEGTSESAT-PESGPGTSTEPSEGSAPGT SESATPESGPGSEPATSGSETPGTSESAT-PESGPGSEPATSGSETPGTSESATPESGPGTSTE PSEGSAPGSPAGSPTSTEEGTSESAT-PESGPGSEPATSGSETPGTSESATPESGPGSPAGSP TSTEEGSPAGSPTSTEEGTSTEPSEGSAPGTSESAT-PESGPGTSESATPESGPGTSPSATPES GPGSEPATSG-SETPGSEPATSGSETPGSPAGSPTSTEEGT-STEPSEGSAPGTSTEPSEGSAP GSEPATSGSETPGTSESAGEPEA (SEQ ID NO: 1000). In some embodiments, the chimeric polypeptide comprises an amino acid sequence that has at least 85% identity to SEQ ID NO: 1000. In some embodiments, the chimeric polypeptide comprises an amino acid sequence that has at least 90% identity to SEQ ID NO: 1000. In some embodiments, the chimeric polypeptide comprises an amino acid sequence that has at least 91% identity to SEQ ID NO: 1000. In some embodiments, the chimeric polypeptide comprises an amino acid sequence that has at least 92% identity to SEQ ID NO: 1000. In some embodiments, the chimeric polypeptide comprises an amino acid sequence that has at least 93% identity to SEQ ID NO: 1000. In some embodiments, the chimeric polypeptide comprises an amino acid sequence that has at least 94% identity to SEQ ID NO: 1000. In some embodiments, the chimeric polypeptide comprises an amino acid sequence that has at least 95% identity to SEQ ID NO: 1000. In some embodiments, the chimeric polypeptide comprises an amino acid sequence that has at least 96% identity to SEQ ID NO: 1000. In some embodiments, the chimeric polypeptide comprises an amino acid sequence that has at least 97% identity to SEQ ID NO: 1000. In some embodiments, the chimeric polypeptide comprises an amino acid sequence that has at least 98% identity to SEQ ID NO: 1000. In some embodiments, the chimeric polypeptide comprises an amino acid sequence that has at least 99% identity to SEQ ID NO: 1000. In some embodiments, the chimeric polypeptide comprises an amino acid sequence that has 100% identity to SEQ ID NO: 1000.

In some embodiments, the chimeric polypeptide comprises the following amino acid sequence:

(SEQ ID NO: 1000)
ASSATPESGPGTSTEPSEGSAPGTSESATPESGPGSGPGTSESATPGTS

ESATPESGPGSEPATSGSETPGTSESATPESGPGTSTEPSEGSAPGSPA

GSPTSTEEGTSESATPESGPGSEPATSGSETPGTSESATPESGPGSPAG

SPTSTEEGSPAGSPTSTEEGTSTEPSEGSAPGTSESATPESGPGTSESA

TPESGPGTSESATPESGPGSEPATSGSETPGSEPATSGSETPGSPAGSP

TSTEEGTSTEPSEGSAPGTSTEPSEGSAPGSEPATSGSETPGTSESATP

EAGRSASHTPAGLTGPGTSESATPESQVQLVESGGGWVQPGRSLRLSCA

ASGRTFGIYVWGWFRQAPGKEREFVGAMSWSGSNRKVSDSVKGRFTISR

DNSKNTLYLQMNSLRAEDTAVYYCAASNKEYGRTWYDFNESDYWGQGTQ

VTVSSGGGGSGGGSELVVTQEPSLTVSPGGTVTLTCRSSNGAVTSSNYA

NWVQQKPGQAPRGLIGGTNKRAPGTPARFSGSLLGGKAALTLSGVQPED

EAVYYCALWYPNLWVFGGGTKLTVLSESATPESGPGTSPGATPESGPGT

SESATPEVQLVESGGGIVQPGGSLRLSCAASGFTFSTYAMNWVRQAPGK

GLEWVGRIRTKRNNYATYYADSVKGRFTISRDDSKNTVYLQMNSLKTED

TAVYYCVRHENFGNSYVSWFAHWGQGTLVTVSSGTATPESGPGEAGRSA

SHTPAGLTGPATPESGPGTSESATPESGPGSPAGSPTSTEEGTSESATP

ESGPGSEPATSGSETPGTSESATPESGPGTSTEPSEGSAPGTSTEPSEG

SAPGTSTEPSEGSAPGTSTEPSEGSAPGTSTEPSEGSAPGTSTEPSEGS

APGSPAGSPTSTEEGTSTEPSEGSAPGTSESATPESGPGSEPATSGSET

PGTSESATPESGPGSEPATSGSETPGTSESATPESGPGTSTEPSEGSAP

GTSESATPESGPGSPAGSPTSTEEGSPAGSPTSTEEGSPAGSPTSTEEG

TSESATPESGPGTSTEPSEGSAPGTSESATPESGPGSEPATSGSETPGT

SESATPESGPGSEPATSGSETPGTSESATPESGPGTSTEPSEGSAPGSP

AGSPTSTEEGTSESATPESGPGSEPATSGSETPGTSESATPESGPGSPA

GSPTSTEEGSPAGSPTSTEEGTSTEPSEGSAPGTSESATPESGPGTSES

ATPESGPGTSPSATPESGPGSEPATSGSETPGSEPATSGSETPGSPAGS

PTSTEEGTSTEPSEGSAPGTSTEPSEGSAPGSEPATSGSETPGTSESAG

EPEA.

Certain aspects of the present disclosure are directed to a pharmaceutical composition comprising the chimeric polypeptide described herein and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, injection device comprises a syringe.

Certain aspects of the present disclosure are directed to a polynucleotide sequence encoding the chimeric polypeptide described herein.

Certain aspects of the present disclosure are directed to an expression vector comprising the polynucleotide described herein.

Certain aspects of the present disclosure are directed to a host cell comprising the expression vector described herein.

Certain aspects of the present disclosure are directed to a method of producing the chimeric polypeptide described herein. In some embodiments, the method further comprises isolating the chimeric polypeptide from a host cell.

Certain aspects of the present disclosure are directed to a method of treating cancer in a subject in need thereof, the method comprising administering an effective amount of the chimeric polypeptide described herein to the subject.

In some embodiments, the cancer comprises a solid tumor. In some embodiments, the cancer is a carcinoma. In some embodiments, the cancer is prostate cancer. In some embodiments, the prostate cancer is metastatic prostate cancer. In some embodiments, the prostate cancer is androgen-independent. In some embodiments, the prostate cancer is non-metastatic castration-resistant prostate cancer (nm-CRPC). In some embodiments, the prostate cancer is metastatic castration-resistant prostate cancer (mCRPC).

In some embodiments, the method further comprises administering docetaxel to the subject.

In some embodiments, the method further comprises administering a checkpoint inhibitor to the subject. In some embodiments, the checkpoint inhibitor is a PD-1 inhibitor, a PD-L1 inhibitor, or a CTLA-4 inhibitor. In some embodiments, the checkpoint inhibitor is an anti-PD-1 antibody or an anti-PD-L1 antibody. In some embodiments, the checkpoint inhibitor is pembrolizumab or cemiplimab.

Certain aspects of the present disclosure are directed to a linker polypeptide comprising an amino acid sequence that has at least 85%, 90%, 91%, 92%, 93%, 94%, 95%, 96%, 97%, 98%, or 99% identity, or 100% identity, to SESATPESGPGTSPGATPESGPGTSESATP (SEQ ID NO: 81). Certain aspects of the present disclosure are directed to a linker polypeptide comprising an amino acid sequence that has at least 85% identity to SESATPESGPGTSPGATPESGPGTSESATP (SEQ ID NO: 81). Certain aspects of the present disclosure are directed to a linker polypeptide comprising an amino acid sequence that has at least 90% identity to SESATPESGPGTSPGATPESGPGTSESATP (SEQ ID NO: 81). Certain aspects of the present disclosure are directed to a linker polypeptide comprising an amino acid sequence that has at least 91% identity to SESATPESGPGTSPGATPESGPGTSESATP (SEQ ID NO: 81). Certain aspects of the present disclosure are directed to a linker polypeptide comprising an amino acid sequence that has at least 92% identity to SESATPESGPGTSPGATPESGPGTSESATP (SEQ ID NO: 81). Certain aspects of the present disclosure are directed to a linker polypeptide comprising an amino acid sequence that has at least 93% identity to SESATPESGPGTSPGATPESGPGTSESATP (SEQ ID NO: 81). Certain aspects of the present disclosure are directed to a linker polypeptide comprising an amino acid sequence that has at least 94% identity to SESATPESGPGTSPGATPESGPGTSESATP (SEQ ID NO: 81). Certain aspects of the present disclosure are directed to a linker polypeptide comprising an amino acid sequence that has at least 95% identity to SESATPESGPGTSPGATPESGPGTSESATP (SEQ ID NO: 81). Certain aspects of the present disclosure are directed to a linker polypeptide comprising an amino acid sequence that has at least 96% identity to SESATPESGPGTSPGATPESGPGTSESATP (SEQ ID NO: 81). Certain aspects of the present disclosure are directed to a linker polypeptide comprising an amino acid sequence that has at least 97% identity to SESATPESGPGTSPGATPESGPGTSESATP (SEQ ID NO: 81). Certain aspects of the present disclosure are directed to a linker polypeptide comprising an amino acid sequence that has at least 98% identity to SESATPESGPGTSPGATPESGPGTSESATP (SEQ ID NO:

81). Certain aspects of the present disclosure are directed to a linker polypeptide comprising an amino acid sequence that has at least 99% identity to SESATPESGPGTSPGAT-PESGPGTSESATP (SEQ ID NO: 81). Certain aspects of the present disclosure are directed to a linker polypeptide comprising an amino acid sequence that has 100% identity to SESATPESGPGTSPGATPESGPGTSESATP (SEQ ID NO: 81).

In some embodiments, the linker polypeptide is cleavable by a non-mammalian protease. In some embodiments, the non-mammalian protease is Glu-C.

In some embodiments, the linker polypeptide connects a first polypeptide moiety to a second polypeptide moiety. In some embodiments, the first polypeptide moiety is a VL domain and the second polypeptide moiety is a VH domain.

Certain aspects of the present disclosure are directed to an antigen binding polypeptide comprising a VL domain and a VH domain, wherein the VL domain is linked to the VH domain by a linker polypeptide comprising an amino acid sequence that has at least 85%, 90%, 91%, 92%, 93%, 94%, 95%, 96%, 97%, 98%, or 99% identity, or 100% identity, to

SESATPESGPGTSPGATPESGPGTSESATP. (SEQ ID NO: 81)

In some embodiments, the linker polypeptide is cleavable by a non-mammalian protease. In some embodiments, the non-mammalian protease is Glu-C.

In some embodiments, the antigen binding polypeptide is an scFv.

In some embodiments, the antigen is CD3. In some embodiments, the antigen is CD3 epsilon.

In some embodiments, the VL domain is N-terminal to the VH domain. In some embodiments, the VH domain is N-terminal to the VL domain.

Certain aspects of the present disclosure are directed to a pharmaceutical composition comprising the linker polypeptide described herein or the antigen binding polypeptide described herein, and at least one pharmaceutically acceptable excipient.

In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the linker described herein or the antigen binding polypeptide described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the linker described herein or the antigen binding polypeptide described herein. In some embodiments, the method further comprises isolating the linker or antigen binding polypeptide from a host cell.

Certain aspects of the present disclosure are directed to an isolated polypeptide comprising a protease-cleavable amino acid sequence comprising the sequence: EAGRSAXHT-PAGLTGP (SEQ ID NO: 7627), wherein X is any amino acid other than N. In some embodiments, X is S.

In some embodiments, the isolated polypeptide is not cleavable by legumain. In some embodiments, the isolated polypeptide is not cleavable by legumain in human blood, plasma, or serum. In some embodiments, the isolated polypeptide is not cleavable upon incubation with about 1 nM or less legumain for about 20 hours. In some embodiments, the isolated polypeptide is not cleavable upon incubation with about 1 nM or less legumain for about 20 hours in human blood, plasma, or serum.

In some embodiments, legumain cleaves the isolated polypeptide in human plasma at a rate that is less than about 50% of the rate that RSR-2295 (EAGRSANHTPAGLTGP) (SEQ ID NO:7048) is cleaved by legumain. In some embodiments, legumain cleaves the isolated polypeptide in human plasma at a rate that is less than about 25% of the rate that RSR-2295 (EAGRSANHTPAGLTGP) (SEQ ID NO:7048) is cleaved by legumain. In some embodiments, legumain cleaves the isolated polypeptide in human plasma at a rate that is less than about 10% of the rate that RSR-2295 (EAGRSANHTPAGLTGP) (SEQ ID NO:7048) is cleaved by legumain. In some embodiments, legumain cleaves the isolated polypeptide in human plasma at a rate that is less than about 5% of the rate that RSR-2295 (EAGRSANHT-PAGLTGP) (SEQ ID NO:7048) is cleaved by legumain. In some embodiments, legumain cleaves the isolated polypeptide in human plasma at a rate that is less than about 2.5% of the rate that RSR-2295 (EAGRSANHTPAGLTGP) (SEQ ID NO:7048) is cleaved by legumain.

Certain aspects of the present disclosure are directed to a pharmaceutical composition comprising the isolated polypeptide described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the isolated polypeptide described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the isolated polypeptide described herein. In some embodiments, the method further comprises isolating the isolated polypeptide from a host cell.

Certain aspects of the present disclosure are directed to a fusion protein comprising a protease-cleavable amino acid sequence comprising the sequence: EAGRSAXHT-PAGLTGP (SEQ ID NO: 7627), wherein X is any amino acid other than N, wherein the protease-cleavable amino acid sequence links a first polypeptide moiety to a second polypeptide moiety. In some embodiments, X is S.

In some embodiments, the fusion protein is not cleavable by legumain. In some embodiments, the fusion protein is not cleavable by legumain in human blood, plasma, or serum. In some embodiments, the fusion protein is not cleavable upon incubation with about 1 nM or less legumain for about 20 hours. In some embodiments, the fusion protein is not cleavable upon incubation with about 1 nM or less legumain for about 20 hours in human blood, plasma, or serum.

In some embodiments, legumain cleaves the protease-cleavable amino acid sequence in human plasma at a rate that is less than about 50% of the rate that RSR-2295 (EAGRSANHTPAGLTGP) (SEQ ID NO:7048) is cleaved by legumain. In some embodiments, legumain cleaves the protease-cleavable amino acid sequence in human plasma at a rate that is less than about 25% of the rate that RSR-2295 (EAGRSANHTPAGLTGP) (SEQ ID NO:7048) is cleaved by legumain. In some embodiments, legumain cleaves the protease-cleavable amino acid sequence in human plasma at a rate that is less than about 10% of the rate that RSR-2295 (EAGRSANHTPAGLTGP) (SEQ ID NO:7048) is cleaved by legumain. In some embodiments, legumain cleaves the protease-cleavable amino acid sequence in human plasma at a rate that is less than about 5% of the rate that RSR-2295 (EAGRSANHTPAGLTGP) (SEQ ID NO:7048) is cleaved by legumain. In some embodiments, legumain cleaves the protease-cleavable amino acid sequence in human plasma at a rate that is less than about 2.5% of the rate that RSR-2295 (EAGRSANHTPAGLTGP) (SEQ ID NO:7048) is cleaved by legumain.

In some embodiments, the first polypeptide moiety comprises an antigen-binding domain and the second polypeptide moiety comprises a masking polypeptide.

In some embodiments, the first polypeptide moiety comprises an antigen-binding domain and the second polypeptide moiety is a cytokine, an enzyme, a hormone, a growth factor, a chemotherapeutic polypeptide, an antiviral polypeptide, or a toxin.

In some embodiments, the first polypeptide moiety is a cytokine, an enzyme, a hormone, a growth factor, a chemotherapeutic polypeptide, an antiviral polypeptide, or a toxin and the second polypeptide moiety is a masking polypeptide.

In some embodiments, the masking polypeptide comprises an ELNN.

In some embodiments, the fusion protein comprises a single polypeptide chain, which comprises, in the N terminal to C terminal direction, the first polypeptide then the protease-cleavable amino acid sequence then the second polypeptide moiety. In some embodiments, the fusion protein comprises a single polypeptide chain, which comprises, in the N terminal to C terminal direction, the second polypeptide then the protease-cleavable amino acid sequence then the first polypeptide moiety.

Certain aspects of the present disclosure are directed to a pharmaceutical composition comprising the fusion protein described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the fusion protein described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the fusion protein described herein. In some embodiments, the method further comprises isolating the fusion protein from a host cell.

Certain aspects of the present disclosure are directed to an ELNN polypeptide comprising the following amino acid sequence:

```
                                    (SEQ ID NO: 8021)
ASSATPESGPGTSTEPSEGSAPGTSESATPESGPGSGPGTSESATPGTS

ESATPESGPGSEPATSGSETPGTSESATPESGPGTSTEPSEGSAPGSPA

GSPTSTEEGTSESATPESGPGSEPATSGSETPGTSESATPESGPGSPAG

SPTSTEEGSPAGSPTSTEEGTSTEPSEGSAPGTSESATPESGPGTSESA

TPESGPGTSESATPESGPGSEPATSGSETPGSEPATSGSETPGSPAGSP

TSTEEGTSTEPSEGSAPGTSTEPSEGSAPGSEPATSGSETPGTSESAT

P.
```

Certain aspects of the present disclosure are directed to an ELNN polypeptide comprising the following amino acid sequence:

```
                                    (SEQ ID NO: 8022)
ATPESGPGTSESATPESGPGSPAGSPTSTEEGTSESATPESGPGSEPAT

SGSETPGTSESATPESGPGTSTEPSEGSAPGTSTEPSEGSAPGTSTEPS

EGSAPGTSTEPSEGSAPGTSTEPSEGSAPGTSTEPSEGSAPGSPAGSPT

STEEGTSTEPSEGSAPGTSESATPESGPGSEPATSGSETPGTSESATPE

SGPGSEPATSGSETPGTSESATPESGPGTSTEPSEGSAPGTSESATPES

GPGSPAGSPTSTEEGSPAGSPTSTEEGSPAGSPTSTEEGTSESATPESG

PGTSTEPSEGSAPGTSESATPESGPGSEPATSGSETPGTSESATPESGP

GSEPATSGSETPGTSESATPESGPGTSTEPSEGSAPGSPAGSPTSTEEG

TSESATPESGPGSEPATSGSETPGTSESATPESGPGSPAGSPTSTEEGS

PAGSPTSTEEGTSTEPSEGSAPGTSESATPESGPGTSESATPESGPGTS

PSATPESGPGSEPATSGSETPGSEPATSGSETPGSPAGSPTSTEEGTST

EPSEGSAPGTSTEPSEGSAPGSEPATSGSETPGTSESAGEPEA.
```

Certain aspects of the present disclosure are directed to a fusion protein comprising the ELNN polypeptide described herein.

Certain aspects of the present disclosure are directed to a pharmaceutical composition comprising the ELNN polypeptide described herein, or the fusion protein described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the ELNN polypeptide described herein, or the fusion protein described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the ELNN polypeptide described herein, or the fusion protein described herein.

In some embodiments, the method further comprises isolating the ELNN polypeptide or the fusion protein, from a host cell.

Certain aspects of the present disclosure are directed to a barcode fragment comprising an amino acid sequence that has at least 85%, 90%, 91%, 92%, 93%, 94%, 95%, 96%, 97%, 98%, or 99% identity, or 100% identity, to SGPGTGTSATPE (SEQ ID NO:1010), SGPGSGPGTSE (SEQ ID NO:78), SGPGTTPGTTPE (SEQ ID NO:1011), SGPGTPPTSTPE (SEQ ID NO:1012), SGPGTSPSATPE (SEQ ID NO:79), SGPGTGSAGTPE (SEQ ID NO:1013), SGPGTGGAGTPE (SEQ ID NO:1014), SGPGTSPGATPE (SEQ ID NO:1015), SGPGTSGSGTPE (SEQ ID NO:1016), SGPGTSSASTPE (SEQ ID NO:1017), SGPGTGAGTTPE (SEQ ID NO:1018), SGPGTGSTSTPE (SEQ ID NO:1019), TPGSEPATSGSE (SEQ ID NO:1020), GSAPGTSTEPSE (SEQ ID NO:1021), SGPGTAGSGTPE (SEQ ID NO:1022), SGPGTSSGGTPE (SEQ ID NO:1023), SGPGTAGPATPE (SEQ ID NO:1024), SGPGTPGTGTPE (SEQ ID NO:1025), SGPGTGGPTTPE (SEQ ID NO:1026), or SGPGTGSGSTPE (SEQ ID NO:1027).

Certain aspects of the present disclosure are directed to a barcode fragment comprising an amino acid sequence that has at least 85%, 90%, 91%, 92%, 93%, 94%, 95%, 96%, 97%, 98%, or 99% identity, or 100% identity, to SGPGSGPGTSE (SEQ ID NO:78) or SGPGTSPSATPE (SEQ ID NO:79).

In some embodiments, the barcode fragment comprises the amino acid sequence: SGPGSGPGTSE (SEQ ID NO:78). In some embodiments, the barcode fragment comprises the amino acid sequence: SGPGTSPSATPE (SEQ ID NO:79).

Certain aspects of the present disclosure are directed to a fusion protein comprising the barcode fragment described herein.

Certain aspects of the present disclosure are directed to a fusion protein comprising a Glu-C cleavage site comprising one of the following amino acid sequences: ATPESGPG (SEQ ID NO:9020), SGSETPGT (SEQ ID NO:9021), and GTSESATP (SEQ ID NO:9022).

Certain aspects of the present disclosure are directed to a fusion protein comprising at least one of the following amino acid sequences: SGPE.SGPGX$_n$SGPE.SGPG (SEQ ID NO:9023), SGPE.SGPGX$_n$ATPE.SGPG (SEQ ID NO:9024), SGPE.SGPGX$_n$GTSE.SATP (SEQ ID NO:9025), SGPE.SGPGX$_n$TTPE.SGPG (SEQ ID NO:9026), SGPE.SGPGX$_n$STPE.SGPG (SEQ ID NO:9027), SGPE.SGPGX$_n$GTPE.SGPG (SEQ ID NO:9028), SGPE.SGPGX$_n$GTPE.TPGS (SEQ ID NO:9029), SGPE.SGPGX$_n$GTPE.TPGS (SEQ ID NO:9029), SGPE.SGPGX$_n$SGSE.TGTP (SEQ ID NO:9030), SGPE.SGPGX$_n$GTPE.GSAP (SEQ ID NO:9031), SGPE.SGPGX$_n$EPSE.SATP (SEQ ID NO:9032), ATPE.SGPGX$_n$SGPE.SGPG (SEQ ID NO:9033), ATPE.SGPGX$_n$ATPE.SGPG (SEQ ID NO:9034), ATPE.SGPGX$_n$GTSE.SATP (SEQ ID NO:9035), ATPE.SGPGX$_n$TTPE.SGPG (SEQ ID NO:9036), ATPE.SGPGX$_n$STPE.SGPG (SEQ ID NO:9037), ATPE.SGPGX$_n$GTPE.SGPG (SEQ ID NO:9043), ATPE.SGPGX$_n$GTPE.TPGS (SEQ ID NO:9045), ATPE.SGPGX$_n$SGSE.TGTP (SEQ ID NO:9046), ATPE.SGPGX$_n$GTPE.GSAP (SEQ ID NO:9047), ATPE.SGPGX$_n$EPSE.SATP (SEQ ID NO:9048), GTSE.SATPX$_n$SGPE.SGPG (SEQ ID NO:9049), GTSE.SATPX$_n$ATPE.SGPG (SEQ ID NO:9050), GTSE.SATPX$_n$GTSE.SATP (SEQ ID NO:9051), GTSE.SATPX$_n$TTPE.SGPG (SEQ ID NO:9052), GTSE.SATPX$_n$STPE.SGPG (SEQ ID NO:9053), GTSE.SATPX$_n$GTPE.SGPG (SEQ ID NO:9054), GTSE.SATPX$_n$GTPE.TPGS (SEQ ID NO:9055), GTSE.SATPX$_n$SGSE.TGTP (SEQ ID NO:9056), GTSE.SATPX$_n$GTPE.GSAP (SEQ ID NO:9057), GTSE.SATPX$_n$EPSE.SATP (SEQ ID NO:9058), TTPE.SGPGX$_n$SGPE.SGPG (SEQ ID NO:9059), TTPE.SGPGX$_n$ATPE.SGPG (SEQ ID NO:9060), TTPE.SGPGX$_n$GTSE.SATP (SEQ ID NO:9061), TTPE.SGPGX$_n$TTPE.SGPG (SEQ ID NO:9062), TTPE.SGPGX$_n$STPE.SGPG (SEQ ID NO:9064), TTPE.SGPGX$_n$GTPE.SGPG (SEQ ID NO:9065), TTPE.SGPGX$_n$GTPE.TPGS (SEQ ID NO:9066), TTPE.SGPGX$_n$SGSE.TGTP (SEQ ID NO:9067), TTPE.SGPGX$_n$GTPE.GSAP (SEQ ID NO:9068), TTPE.SGPGX$_n$EPSE.SATP (SEQ ID NO:9069), STPE.SGPGX$_n$SGPE.SGPG (SEQ ID NO:9070), STPE.SGPGX$_n$ATPE.SGPG (SEQ ID NO:9071), STPE.SGPGX$_n$GTSE.SATP (SEQ ID NO:9072), STPE.SGPGX$_n$TTPE.SGPG (SEQ ID NO:9073), STPE.SGPGX$_n$STPE.SGPG (SEQ ID NO:9074), STPE.SGPGX$_n$GTPE.SGPG (SEQ ID NO:9076), STPE.SGPGX$_n$GTPE.TPGS (SEQ ID NO:9077), STPE.SGPGX$_n$SGSE.TGTP (SEQ ID NO:9078), STPE.SGPGX$_n$GTPE.GSAP (SEQ ID NO:9079), STPE.SGPGX$_n$EPSE.SATP (SEQ ID NO:9175), GTPE.SGPGX$_n$SGPE.SGPG (SEQ ID NO:9081), GTPE.SGPGX$_n$ATPE.SGPG (SEQ ID NO:9082), GTPE.SGPGX$_n$GTSE.SATP (SEQ ID NO:9083), GTPE.SGPGX$_n$TTPE.SGPG (SEQ ID NO:9084), GTPE.SGPGX$_n$STPE.SGPG (SEQ ID NO:9086), GTPE.SGPGX$_n$GTPE.SGPG (SEQ ID NO:9088), GTPE.SGPGX$_n$GTPE.TPGS (SEQ ID NO:9090), GTPE.SGPGX$_n$SGSE.TGTP (SEQ ID NO:9091), GTPE.SGPGX$_n$GTPE.GSAP (SEQ ID NO:9092), GTPE.SGPGX$_n$EPSE.SATP (SEQ ID NO:9093), GTPE.TPGSX$_n$SGPE.SGPG (SEQ ID NO:9094), GTPE.TPGSX$_n$ATPE.SGPG (SEQ ID NO:9095), GTPE.TPGSX$_n$GTSE.SATP (SEQ ID NO:9096), GTPE.TPGSX$_n$TTPE.SGPG (SEQ ID NO:9097), GTPE.TPGSX$_n$STPE.SGPG (SEQ ID NO:9098), GTPE.TPGSX$_n$GTPE.SGPG (SEQ ID NO:9099), GTPE.TPGSX$_n$GTPE.TPGS (SEQ ID NO:9100), GTPE.TPGSX$_n$SGSE.TGTP (SEQ ID NO:9101), GTPE.TPGSX$_n$GTPE.GSAP (SEQ ID NO:9103), GTPE.TPGSX$_n$EPSE.SATP (SEQ ID NO:9104), SGSE.TGTPX$_n$SGPE.SGPG (SEQ ID NO:9105), SGSE.TGTPX$_n$ATPE.SGPG (SEQ ID NO:9106), SGSE.TGTPX$_n$GTSE.SATP (SEQ ID NO:9107), SGSE.TGTPX$_n$TTPE.SGPG (SEQ ID NO:9108), SGSE.TGTPX$_n$STPE.SGPG (SEQ ID NO:9109), SGSE.TGTPX$_n$GTPE.SGPG (SEQ ID NO:9110), SGSE.TGTPX$_n$GTPE.TPGS (SEQ ID NO:9111), SGSE.TGTPX$_n$SGSE.TGTP (SEQ ID NO:9112), SGSE.TGTPX$_n$GTPE.GSAP (SEQ ID NO:9113), SGSE.TGTPX$_n$EPSE.SATP (SEQ ID NO:9114), GTPE.GSAPX$_n$SGPE.SGPG (SEQ ID NO:9115), GTPE.GSAPX$_n$ATPE.SGPG (SEQ ID NO:9116), GTPE.GSAPX$_n$GTSE.SATP (SEQ ID NO:9117), GTPE.GSAPX$_n$TTPE.SGPG (SEQ ID NO:9118), GTPE.GSAPX$_n$STPE.SGPG (SEQ ID NO:9119), GTPE.GSAPX$_n$GTPE.SGPG (SEQ ID NO:9120), GTPE.GSAPX$_n$GTPE.TPGS (SEQ ID NO:9121), GTPE.GSAPX$_n$SGSE.TGTP (SEQ ID NO:9122), GTPE.GSAPX$_n$GTPE.GSAP (SEQ ID NO:9123),
GTPE.GSAPX$_n$EPSE.SATP (SEQ ID NO:9124),
EPSE.SATPX$_n$SGPE.SGPG (SEQ ID NO:9126),
EPSE.SATPX$_n$ATPE.SGPG (SEQ ID NO:9127),
EPSE.SATPX$_n$GTSE.SATP (SEQ ID NO:9128),
EPSE.SATPX$_n$TTPE.SGPG (SEQ ID NO:9129),
EPSE.SATPX$_n$STPE.SGPG (SEQ ID NO:9130),
EPSE.SATPX$_n$GTPE.SGPG (SEQ ID NO:9131),
EPSE.SATPX$_n$GTPE.TPGS (SEQ ID NO:9132),
EPSE.SATPX$_n$SGSE.TGTP (SEQ ID NO:9133),
EPSE.SATPX$_n$GTPE.GSAP (SEQ ID NO:9134), or
EPSE.SATPX$_n$EPSE.SATP (SEQ ID NO:9135), wherein each "." is a Glu-C cleavage site and n is any integer from 0 to 50.

In some embodiments, the fusion protein comprises at least one of the following amino acid sequences:
SGPE.SGPGX$_n$ATPE.SGPG (SEQ ID NO:9038),
ATPE.SGPGX$_n$GTSE.SATP (SEQ ID NO:9040),
ATPE.SGPGX$_n$TTPE.SGPG (SEQ ID NO:9041),
ATPE.SGPGX$_n$STPE.SGPG (SEQ ID NO:9042),
ATPE.SGPGX$_n$ATPE.SGPG (SEQ ID NO:9039),
ATPE.SGPGX$_n$GTPE.SGPG (SEQ ID NO:9044),
ATPE.SGPGX$_n$GTPE.SGPG (SEQ ID NO:9044),
ATPE.SGPGX$_n$ATPE.SGPG (SEQ ID NO:9039),
GTPE.SGPGX$_n$GTPE.SGPG (SEQ ID NO:9089),
GTPE.SGPGX$_n$STPE.SGPG (SEQ ID NO:9087),
GTPE.SGPGX$_n$TTPE.SGPG (SEQ ID NO:9085),
GTPE.SGPGX$_n$STPE.SGPG (SEQ ID NO:9087),
GTPE.TPGSX$_n$SGSE.TGTP (SEQ ID NO:9102),
GTPE.GSAPX$_n$EPSE.SATP (SEQ ID NO:9125),
ATPE.SGPGX$_n$GTPE.SGPG (SEQ ID NO:9044),
ATPE.SGPGX$_n$GTPE.SGPG (SEQ ID NO:9044),
ATPE.SGPGX$_n$ATPE.SGPG (SEQ ID NO:9039),
ATPE.SGPGX$_n$GTPE.SGPG (SEQ ID NO:9044),
TTPE.SGPGX$_n$TTPE.SGPG (SEQ ID NO:9063), or
STPE.SGPGX$_n$STPE.SGPG (SEQ ID NO:9075), wherein each "." is a Glu-C cleavage site and n is any integer from 0 to 30.

In some embodiments, n is any integer from 1 to 20. In some embodiments, n is any integer from 5 to 15. In some embodiments, n is any integer from 3 to 7. In some embodiments, n is any integer from 5 to 10. In some embodiments, n is 9. In some embodiments, n is 4.

In some embodiments, X$_n$ is PGTGTSAT (SEQ ID NO:9136), PGSGPGT (SEQ ID NO:9137), PGTTPGTT (SEQ ID NO:9138), PGTPPTST (SEQ ID NO:9139), PGTSPSAT (SEQ ID NO:9140), PGTGSAGT (SEQ ID NO:9141), PGTGGAGT (SEQ ID NO:9142), PGTSPGAT (SEQ ID NO:9143), PGTSGSGT (SEQ ID NO:9144), PGTSSAST (SEQ ID NO:9145), PGTGAGTT (SEQ ID NO:9146), PGTGSTST (SEQ ID NO:9147), GSEPATSG (SEQ ID NO:9148), APGTSTEP (SEQ ID NO:9149), PGTAGSGT (SEQ ID NO:9150), PGTSSGGT (SEQ ID NO:9151), PGTAGPAT (SEQ ID NO:9152), PGTPGTGT (SEQ ID NO:9153), PGTGGPTT (SEQ ID NO:9154), or PGTGSGST (SEQ ID NO:9155).

In some embodiments, X$_n$ is TGTS (SEQ ID NO:9156), SGP, TTPG (SEQ ID NO:9157), TPPT (SEQ ID NO:9158), TSPS (SEQ ID NO:9159), TGSA (SEQ ID NO:9160), TGGA (SEQ ID NO:9161), TSPG (SEQ ID NO:9162), TSGS (SEQ ID NO:9163), TSSA (SEQ ID NO:9164), TGAG (SEQ ID NO:9165), TGST (SEQ ID NO:9166), EPAT (SEQ ID NO:9167), GTST (SEQ ID NO:9168), TAGS (SEQ ID NO:9169), TSSG (SEQ ID NO:9170), TAGP (SEQ ID NO:9171), TPGT (SEQ ID NO:9172), TGGP (SEQ ID NO:9173), or TGSG (SEQ ID NO:9174).

Certain aspects of the present disclosure are directed to a pharmaceutical composition comprising the barcode fragment described herein, or the fusion protein described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the barcode fragment described herein, or the fusion protein described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the barcode fragment described herein, or the fusion protein described herein. In some embodiments, the method further comprises isolating the barcode fragment or the fusion protein from a host cell.

Certain aspects of the present disclosure are directed to an antibody or an antigen-binding fragment thereof that specifically binds PSMA, comprising a VHH domain or a fragment thereof comprising three VHH CDRs, wherein the three VHH CDRs comprise the CDR1, CDR2, and CDR3 from the following amino acid sequence:

(SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

Certain aspects of the present disclosure are directed to an antibody or an antigen-binding fragment thereof that specifically binds PSMA, comprising the following CDRs: a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH CDR2 with an amino acid sequence that has at least 85%, 90%, 91%, 92%, 93%, 94%, 95%, 96%, 97%, 98%, or 99% identity, or 100% identity, to AMSWSG-SNRKVSDSVKG (SEQ ID NO:9004); and a VHH CDR3 with an amino acid sequence that has at least 85%, 90%, 91%, 92%, 93%, 94%, 95%, 96%, 97%, 98%, or 99% identity, or 100% identity, to (SEQ ID NO: 9005)
AASNKEYGRTWYDFNESDY.

In some embodiments, the antibody or fragment comprises one or more of the following FRs: a VHH FR1 with an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS (SEQ ID NO:9011); a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012); a VHH FR3 with an amino acid sequence that has at least 85%, 90%, 91%, 92%, 93%, 94%, 95%, 96%, 97%, 98%, or 99% identity, or 100% identity, to RFTISRDNSKNT-LYLQMNSLRAEDTAVYYC (SEQ ID NO:9013); and a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

Certain aspects of the present disclosure are directed to an antibody or an antigen-binding fragment thereof that specifically binds PSMA, comprising the following CDRs: a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH CDR2 with an amino acid sequence that has at least 85%, 90%, 91%, 92%, 93%, 94%, 95%, 96%, 97%, 98%, or 99% identity, or 100% identity, to AMSWSG-SNRK (SEQ ID NO:9015); and a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005).

In some embodiments, the antibody or fragment comprises one or more of the following FRs: a VHH FR1 with an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS (SEQ ID NO:9011); a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012); a VHH FR3 with an amino acid sequence that has at least 85%, 90%, 91%, 92%, 93%, 94%, 95%, 96%, 97%, 98%, or 99% identity, or 100% identity, to VSDSVKGRFTISRDNSKNT-LYLQMNSLRAEDTAVYYC (SEQ ID NO:9016); and a VHH FR4 with an amino acid sequence that has at least 85%, 90%, 91%, 92%, 93%, 94%, 95%, 96%, 97%, 98%, or 99% identity, or 100% identity, to (SEQ ID NO: 9014)
WGQGTQVTVSS.

Certain aspects of the present disclosure are directed to an antibody or an antigen-binding fragment thereof that specifically binds PSMA, comprising a VHH comprising an amino acid sequence that has at least 85%, 90%, 91%, 92%, 93%, 94%, 95%, 96%, 97%, 98%, or 99% identity, or 100% identity, to (SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

In some embodiments, the antibody or fragment is an isolated antibody or fragment thereof.

Certain aspects of the present disclosure are directed to an antibody or an antigen-binding fragment thereof that specifically binds PSMA, comprising a VHH comprising an amino acid sequence that has at least 85%, 90%, 91%, 92%, 93%, 94%, 95%, 96%, 97%, 98%, or 99% identity, or 100% identity, to the amino acid sequence of PSMA.2, PSMA.3, PSMA.5, PSMA.6, PSMA.262, or PSMA.263.

Certain aspects of the present disclosure are directed to an antibody or an antigen-binding fragment thereof that specifically binds PSMA, comprising a VHH comprising an amino acid sequence that has at least 85%, 90%, 91%, 92%, 93%, 94%, 95%, 96%, 97%, 98%, or 99% identity, or 100% identity, to: QVQLVESGGGVV-QPGRSLRLSCAASGRTFGIYVX$_{17}$GWFRQAPGK-EREFVGAX$_{18}$SWSGSNRK VSDSVKGRFTIS-RDNSKNTLYLQMNSLRAED-TAVYX$_{19}$CX$_{20}$X$_{21}$SNKX$_{22}$YGRTWYDFNESDYWG QGTQVTVSS (SEQ ID NO:9017), wherein X$_{17}$, X$_{18}$, X$_{19}$, X$_{20}$, X$_{21}$, and X$_6$ each, individually, correspond to any naturally occurring amino acid. In some embodiments, X$_{17}$ corresponds to M or W, X$_{18}$ corresponds to M or I, X$_{19}$ corresponds to F or Y, X$_{20}$ corresponds to A or G, X$_{21}$ corresponds to A or G, and/or X$_{22}$ corresponds to L, W, R, D, E, or G.

In some embodiments, the PSMA comprises the following amino acid sequence:

(SEQ ID NO: 1044)
KSSNEATNITPKHNMKAFLDELKAENIKKFLYNFTQIPHLAGTEQNFQL

AKQIQSQWKEFGLDSVELAHYDVLLSYPNKTHPNYISIINEDGNEIFNT

SLFEPPPPGYENVSDIVPPFSAFSPQGMPEGDLVYVNYARTEDFFKLER

DMKINCSGKIVIARYGKVFRGNKVKNAQLAGAKGVILYSDPADYFAPGV

KSYPDGWNLPGGGVQRGNILNLNGAGDPLTPGYPANEYAYRRGIAEAVG

LPSIPVHPIGYYDAQKLLEKMGGSAPPDSSWRGSLKVPYNVGPGFTGNF

STQKVKMHIHSTNEVTRIYNVIGTLRGAVEPDRYVILGGHRDSWVFGGI

DPQSGAAVVHEIVRSFGTLKKEGWRPRRTILFASWDAEEFGLLGSTEWA

EENSRLLQERGVAYINADSSIEGNYTLRVDCTPLMYSLVHNLTKELKSP

DEGFEGKSLYESWTKKSPSPEFSGMPRISKLGSGNDFEVFFQRLGIASG

RARYTKNWETNKFSGYPLYHSVYETYELVEKFYDPMFKYHLTVAQVRGG

MVFELANSIVLPFDCRDYAVVLRKYADKIYSISMKHPQEMKTYSVSFDS

LFSAVKNFTEIASKFSERLQDFDKSNPIVLRMMNDQLMFLERAFIDPLG

LPDRPFYRHVIYAPSSHNKYAGESFPGIYDALFDIESKVDPSKAWGEVK

RQIYVAAFTVQAAAETLSEVA.

Certain aspects of the present disclosure are directed to an antibody or an antigen-binding fragment thereof that specifically binds CD3, comprising a VL domain and a VH domain, wherein: (i) the VL domain comprises the VL CDRs of the amino acid sequence of ELVVTQEPSLTVSPGGTVTLTCRSSN-GAVTSSNYANWVQQKPGQAPRGLIGGTNKRAPGTPA RFSGSLLGGKAALTLSGVQPEDEAVYY-CALWYPNLWVFGGGTKLTVL (SEQ ID NO: 361); or (ii) the VH domain comprises the VH CDRs of the amino acid sequence of (SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS.

Certain aspects of the present disclosure are directed to an anti-CD3 antibody or an antigen-binding fragment thereof, comprising one or more of the following CDRs: a VL domain CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1); a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6); a VH domain CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12); a VH domain CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and/or a VH domain CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO:10).

In some embodiments, the antibody or fragment comprises one or more of the following FRs: a VL domain FR1 with an amino acid sequence that has at least 85%, 90%, 91%, 92%, 93%, 94%, 95%, 96%, 97%, 98%, or 99% identity, or 100% identity, to ELVVTQEPSLTVSPGGTVTLTC (SEQ ID NO:51); a VL domain FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52); a VL domain FR3 with an amino acid sequence that has at least 85%, 90%, 91%, 92%, 93%, 94%, 95%, 96%, 97%, 98%, or 99% identity, or 100% identity, to GTPARFSGSLLGGKAALTLSGVQPEDEAVYYC (SEQ ID NO:53); a VL domain FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59); a VH domain FR1 with an amino acid sequence that has at least 85%, 90%, 91%, 92%, 93%, 94%, 95%, 96%, 97%, 98%, or 99% identity, or 100% identity, to EVQLVESGGGIVQPGGSLRLSCAAS (SEQ ID NO:400); a VH domain FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401); a VH domain FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and/or a VH domain FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, the antibody or fragment comprises a VL domain.

In some embodiments, the VL domain comprises an amino acid sequence that has at least 85%, 90%, 91%, 92%, 93%, 94%, 95%, 96%, 97%, 98%, or 99% identity, or 100% identity, to:

(SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL.

In some embodiments, the antibody or fragment comprises a VH domain.

In some embodiments, the VH domain comprises an amino acid sequence that has at least 85%, 90%, 91%, 92%, 93%, 94%, 95%, 96%, 97%, 98%, or 99% identity, or 100% identity, to:

(SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS.

Certain aspects of the present disclosure are directed to an antibody or an antigen-binding fragment thereof that specifically binds CD3, comprising a VL domain and a VH domain, wherein the VL domain amino acid sequence SEQ ID NO/VH domain amino acid sequence SEQ ID NO pair is selected from the group consisting of: 896/897; 902/903; 700/701; 702/703; 716/717; 718/719; 728/729; 736/737; 738/739; 740/741; 742/743; 744/745; 746/747; 748/749; 750/751; 752/753; 754/755; 756/757; 758/759; 760/761; 762/763; 764/765; 766/767; 774/775; 776/777; 790/791; 792/793; 798/799; 800/801; 806/807; 808/809; 814/815; 816/817; 822/823; 824/825; or 826/867.

In some embodiments, the antibody or fragment thereof is an isolated antibody or fragment thereof.

In some embodiments, the antibody or fragment thereof is an antibody.

In some embodiments, the antibody or fragment thereof is a Fab, an scFv, or a monoclonal antibody.

In some embodiments, the antibody or fragment thereof is an scFv.

In some embodiments, the VL domain is N-terminal to the VH domain in the scFv

In some embodiments, the VL domain is C-terminal to the VH domain in the scFv.

In some embodiments, the scFv comprises a linker between the VL domain and the VH domain, wherein the linker consists of A, E, G, S, P, and/or T residues.

In some embodiments, the linker is an ELNN.

In some embodiments, the ELNN is cleavable by a non-mammalian protease. In some embodiments, the non-mammalian protease is Glu-C.

In some embodiments, ELNN comprises an amino acid sequence that has at least 85%, 90%, 91%, 92%, 93%, 94%, 95%, 96%, 97%, 98%, or 99% identity, or 100% identity, to SESATPESGPGTSPGATPESGPGTSESATP (SEQ ID NO: 81).

In some embodiments, the scFv comprises an amino acid sequence that has at least 85%, 90%, 91%, 92%, 93%, 94%, 95%, 96%, 97%, 98%, or 99% identity, or 100% identity, to:

(SEQ ID NO: 215)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVLSESATPESGPGTSPGATPESGPGTSESATPEVQLVESG

GGIVQPGGSLRLSCAASGFTFSTYAMNWVRQAPGKGLEWVGRIRTKRNN

YATYYADSVKGRFTISRDDSKNTVYLQMNSLKTEDTAVYYCVRHENFGN

SYVSWFAHWGQGTLVTVSS.

In some embodiments, the CD3 is CD3 epsilon.
In some embodiments, the CD3 epsilon comprises the following amino acid sequence:

(SEQ ID NO: 1043)
DGNEEMGGITQTPYKVSISGTTVILTCPQYPGSEILWQHNDKNIGGDED

DKNIGSDEDHLSLKEFSELEQSGYYVCYPRGSKPEDANFYLYLRARVCE

NCMEMD

Certain aspects of the present disclosure are directed to a pharmaceutical composition comprising the antibody or an antigen-binding fragment thereof described herein, and at least one pharmaceutically acceptable excipient.

In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the antibody or an antigen-binding fragment thereof described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the antibody or an antigen-binding fragment thereof described herein. In some embodiments, the method further comprises isolating the antibody or an antigen-binding fragment thereof of from a host cell.

Certain aspects of the present disclosure are directed to a multispecific antibody comprising an anti-PSMA antibody domain comprising an antibody or antibody fragment described herein and/or an anti-CD3 antibody domain comprising an antibody or antibody fragment described herein.

Certain aspects of the present disclosure are directed to a multispecific antibody comprising an anti-PSMA antibody domain comprising an antibody or antibody fragment described herein and an anti-CD3 antibody domain comprising an antibody or antibody fragment described herein.

In some embodiments, the affinity of the anti-PSMA antibody domain to PSMA is higher than the affinity of the anti-CD3 antibody domain to CD3. In some embodiments, the multispecific antibody is a bispecific antibody. In some embodiments, the bispecific antibody is a T cell engager.

Certain aspects of the present disclosure are directed to a pharmaceutical composition comprising the multispecific antibody described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the multispecific antibody described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the multispecific antibody described herein. In some embodiments, the method further comprises isolating the multispecific antibody from a host cell.

Certain aspects of the present disclosure are directed to a T cell engager comprising a first antigen binding domain that binds to prostate-specific membrane antigen (PSMA) and a second antigen binding domain that binds to cluster of differentiation 3 T cell receptor (CD3), wherein the first antigen binding domain comprises a VHH comprising an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS-GRTFGIYVWGWFRQAPGKEREFVGAMSWSGSNRKV SDSVKGRFTISRDNSKNTLYLQMNSLRAEDTAVYY-CAASNKEYGRTWYDFNESDYWGQGTQ VTVSS (SEQ ID NO: 549); and the second antigen binding domain comprises a VL domain comprising an amino acid sequence that has at least 85%, 90%, 91%, 92%, 93%, 94%, 95%, 96%, 97%, 98%, or 99% identity, or 100% identity, to ELVVTQEPSLTVSPGGTVTLTCRSSN-GAVTSSNYANWVQQKPGQAPRGLIGGTNKRAPGTPA RFSGSLLGGKAALTLSGVQPEDEAVYY-CALWYPNLWVFGGGTKLTVL (SEQ ID NO: 361) and a VH domain comprising an amino acid sequence that has at least 85%, 90%, 91%, 92%, 93%, 94%, 95%, 96%, 97%, 98%, or 99% identity, or 100% identity, to (SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS.

Certain aspects of the present disclosure are directed to a pharmaceutical composition comprising the T cell engager described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the T cell engager described herein.

Certain aspects of the present disclosure are directed to an expression vector comprising the polynucleotide sequence described herein.

Certain aspects of the present disclosure are directed to a host cell comprising the expression vector described herein.

Certain aspects of the present disclosure are directed to a method of producing the T cell engager described herein. In some embodiments, the method further comprises isolating the T cell engager from a host cell.

Certain aspects of the present disclosure are directed to a protease-activatable T cell engager (paTCE) comprising a T cell engager (TCE) described herein, in the form of a single polypeptide chain, wherein the N-terminus of the TCE is fused to a first masking polypeptide by a first protease-cleavable linker and the C-terminus of the TCE is fused to a second masking polypeptide by a second protease-cleavable linker.

In some embodiments, the first masking polypeptide is a first ELNN. In some embodiments, the second masking polypeptide is a second ELNN.

In some embodiments, the TCE comprises an anti-PSMA VHH comprising the following amino acid sequence:

(SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

In some embodiments, the TCE comprises an anti-CD3 scFv comprising a VH domain having the following amino acid sequence: EVQLVESGGGIVQPGGSLRLS-CAASGFTFSTYAMNWVRQAPGKGLEWVGRIRTKRN-NYATYY ADSVKGRFTISRDDSKNTVYLQMNSLKT-EDTAVYYCVRHENFGNSYVSWFAHWGQGTLVTVS S (SEQ ID NO: 311) and a VL domain having the following amino acid sequence:

(SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL.

Certain aspects of the present disclosure are directed to a pharmaceutical composition comprising the paTCE described herein, and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

Certain aspects of the present disclosure are directed to an injection device comprising the pharmaceutical composition described herein. In some embodiments, the injection device comprises a syringe.

Certain aspects of the present disclosure are directed to a polynucleotide sequence encoding the paTCE described herein.

Certain aspects of the present disclosure are directed to a n expression vector comprising the polynucleotide sequence described herein.

Certain aspects of the present disclosure are directed to a host cell comprising the expression vector described herein.

Certain aspects of the present disclosure are directed to a method of producing the paTCE described herein. In some embodiments, the method further comprises isolating the paTCE from a host cell.

Certain aspects of the present disclosure are directed to a chimeric polypeptide, isolated polypeptide, fusion protein, antigen binding polypeptide, antibody or an antigen-binding fragment thereof that specifically binds PSMA, antibody or an antigen-binding fragment thereof that specifically binds CD3, multispecific antibody, T cell engager, or paTCE, produced by the method described herein.

Certain aspects of the present disclosure are directed to a polynucleotide sequence encoding the amino acid sequence: EAGRSAXHTPAGLTGP (SEQ ID NO: 7627), wherein X is any amino acid other than N.

In some embodiments, the polynucleotide is a vector.
In some embodiments, the polynucleotide is an isolated polynucleotide.

Certain aspects of the present disclosure are directed to a cell line that expresses an exogenous polypeptide comprising the amino acid sequence: EAGRSAXHTPAGLTGP (SEQ ID NO: 7627), wherein X is any amino acid other than N.

In some embodiments, the exogenous polypeptide is a fusion protein described herein.

In some embodiments, the cell line is in culture or is frozen in a glass or plastic container.

In some embodiments, the cell line is in a bioreactor.
In some embodiments, the cell is a stable cell line.
In some embodiments, the cell line is a mammalian cell.
In some embodiments, the cell line is a CHO cell or a HEK293 cell.
In some embodiments, the cell line is a prokaryotic cell.
In some embodiments, the cell line is an *Escherichia coli* cell.

Certain aspects of the present disclosure are directed to a non-human animal that comprises an exogenous polypeptide comprising the amino acid sequence: EAGRSAXHT-PAGLTGP (SEQ ID NO: 7627), wherein X is any amino acid other than N. In some embodiments, X is D, E, or Q. In some embodiments, X is G, A, V, L, I. In some embodiments, X is P. In some embodiments, X is F, Y, or W. In some embodiments, X is H, K, or R. In some embodiments, X is S, C, U, T, or M. In some embodiments, X is S.

Certain aspects of the present disclosure are directed to a fusion protein comprising an anti-PSMA antibody or fragment described herein and a biologically active protein.

Certain aspects of the present disclosure are directed to a fusion protein comprising an anti-CD3 antibody or fragment described herein and a biologically active protein.

In some embodiments, the biologically active protein comprises a cytokine, an enzyme, a hormone, a growth factor, a chemotherapeutic polypeptide, an antiviral polypeptide, or a toxin.

Certain aspects of the present disclosure are directed to an immunoconjugate comprising an anti-PSMA antibody or fragment described herein and a compound.

Certain aspects of the present disclosure are directed to an immunoconjugate comprising an anti-CD3 antibody or fragment described herein and a compound.

In some embodiments, the compound comprises chemotherapeutic agent.

In some embodiments, the compound comprises a diagnostic agent.

In some embodiments, the compound comprises a toxin, a radioactive molecule, a contrast agent, or a drug.

The present disclosure provides an isolated antibody or antigen-binding fragment thereof, which specifically binds CD3, comprising a heavy chain variable region (VH) comprising three heavy-chain CDRs, and a light chain variable region (VL) comprising three light-chain CDRs, wherein the three heavy-chain CDRs comprise the CDR1, CDR2, and CDR3 from EVQLVESGGGIVQPGGSLRLSCAASGFTF-STYAMNWVRQAPGKGLEWVGRIRTKRNNYATYY ADSVKGRFTISRDDSKNTVYLQMNSLKTED-TAVYYCVRHENFGNSYVSWFAHWGQGTLVTVS S (SEQ ID NO: 311) and the three light-chain CDRs comprise the CDR1, CDR2, and CDR3 from ELVVTQEPSLTVSPGGTVTLTCRSSN-GAVTSSNYANWVQQKPGQAPRGLIGGTNKRAPGTPA RFSGSLLGGKAALTLSGVQPEDEAVYY-CALWYPNLWVFGGGTKLTVL (SEQ ID NO: 361), and wherein the CDRs are identified by the Kabat definition, the Chothia definition, the AbM definition, the IMGT definition, or the contact definition. In some embodiments, the antibody is an scFv.

Included herein is an antigen binding protein comprising: (i) a light chain variable domain comprising an amino acid sequence at least 90%, 95%, 96%, 97%, 98%, or 99% identical to, or 100% identical to, a light chain variable domain sequence comprising a CDR sequence selected from the group consisting of RSSNGAVTSSNYAN (SEQ ID NO:1), GTNKRAP (SEQ ID NO:4), and ALWYPNLWV (SEQ ID NO:6), and (ii) a heavy chain variable domain comprising an amino acid sequence at least 90%, 95%, 96%, 97%, 98%, or 99% identical to, or 100% identical to, a heavy chain variable domain sequence comprising a CDR sequence selected from the group consisting of SEQ ID NOs: GFTFSTYAMN (SEQ ID NO:12), RIRTKRN-NYATYYADSVKG (SEQ ID NO:13), and HENFGN-SYVSWFAH (SEQ ID NO:10), wherein the antigen binding protein specifically binds to CD3. In some embodiments, the antibody is an scFv.

Disclosed herein is an antibody or antigen-binding fragment thereof, which specifically binds CD3, wherein the antibody or antigen-binding fragment thereof comprises three light chain complementarity determining region (CDR) sequences of SEQ ID NOs: RSSNGAVTSSNYAN (SEQ ID NO:1), GTNKRAP (SEQ ID NO:4), and ALWYPNLWV (SEQ ID NO:6), and three heavy chain complementarity determining region (CDR) sequences of GFTFSTYAMN (SEQ ID NO:12), RIRTKRNNYATYY-ADSVKG (SEQ ID NO:13), and HENFGNSYVSWFAH (SEQ ID NO:10). In some embodiments, the antibody is an scFv.

Included herein is an isolated antibody or antigen-binding fragment thereof, that specifically binds CD3 comprising the amino acid sequence of DGNEEMGGITQTPYKVSISGTT-VILTCPQYPGSEILWQHNDKNIGGDEDDKNIGSD-EDHLSLKE FSELEQSGYYVCYPRGSKPEDANFYLYL-RARVCENCMEMD (SEQ ID NO: 1043), comprising a heavy chain variable region comprising three heavy-chain CDRs, and a light chain variable region comprising three light-chain CDRs, wherein the three heavy-chain CDRs comprise the CDR1, CDR2 and CDR3 from EVQLVES-GGGIVQPGGSLRLSCAASGFTF-STYAMNWVRQAPGKGLEWVGRIRTKRNNYATYY ADSVKGRFTISRDDSKNTVYLQMNSLKTED-TAVYYCVRHENFGNSYVSWFAHWGQGTLVTVS S (SEQ ID NO: 311), and the three light-chain CDRs comprise the CDR1, CDR2 and CDR3 from ELVVTQEPSLTVSPGGTVTLTCRSSN-GAVTSSNYANWVQQKPGQAPRGLIGGTNKRAPGTPA RFSGSLLGGKAALTLSGVQPEDEAVYY-CALWYPNLWVFGGGTKLTVL (SEQ ID NO: 361). In some embodiments, the heavy chain CDR1 comprises GFTFSTYAMN (SEQ ID NO:12), the heavy chain CDR2 comprises RIRTKRNNYATYYADSVKG (SEQ ID NO:13), the heavy chain CDR3 comprises HENFGNSYVSWFAH (SEQ ID NO:10), the light chain CDR1 comprises RSSN-GAVTSSNYAN (SEQ ID NO:1), the light chain CDR2 comprises GTNKRAP (SEQ ID NO:4), and the light chain CDR3 comprises ALWYPNLWV (SEQ ID NO:6). In some embodiments, the heavy chain variable region comprises EVQLVESGGGIVQPGGSLRLSCAASGFTF-STYAMNWVRQAPGKGLEWVGRIRTKRNNYATYY ADSVKGRFTISRDDSKNTVYLQMNSLKTED-TAVYYCVRHENFGNSYVSWFAHWGQGTLVTVS S (SEQ ID NO: 311). In some embodiments, the light chain variable region comprises ELVVTQEPSLTVSPGGTVTLT-CRSSNGAVTSSNYANWVQQKPGQAPRGLIGGTNK-RAPGTPA RFSGSLLGGKAALTLSGVQPEDEAVYY-CALWYPNLWVFGGGTKLTVL (SEQ ID NO: 361). In some embodiments, the heavy chain variable region comprises EVQLVESGGGIVQPGGSLRLSCAASGFTF-STYAMNWVRQAPGKGLEWVGRIRTKRNNYATYY ADSVKGRFTISRDDSKNTVYLQMNSLKTED-TAVYYCVRHENFGNSYVSWFAHWGQGTLVTVS S (SEQ ID NO: 311) and the light chain variable region comprises (SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL.

In some embodiments, included herein is an antibody or antigen-binding fragment thereof, that specifically binds CD3 (e.g., a protein having a heavy chain variable region amino acid sequence of SEQ ID NO: 311 and a light chain variable region amino acid sequence of SEQ ID NO: 361) with a $K_D$ of about 300 nM or less, e.g., as measured by surface plasmon resonance. In some embodiments, the antibody or antigen-binding portion thereof exhibits a $K_D$ of about 200 nM or less, about 150 or less, about 100 nM or less, or about 75 nM or less.

Provided herein is an antibody or antigen-binding fragment thereof, that specifically binds CD3 (e.g., a protein having a heavy chain variable region amino acid sequence of SEQ ID NO: 311 and a light chain variable region amino acid sequence of SEQ ID NO: 361), comprising a heavy chain variable region and a light chain variable region, wherein the antibody or antigen-binding fragment comprises: (a) a heavy chain variable region having an amino acid sequence that is at least 90% identical to the amino acid sequence shown in EVQLVESGGGIVQPGGSLRLS-CAASGFTFSTYAMNWVRQAPGKGLEWVGRIRTKRN-NYATYY ADSVKGRFTISRDDSKNTVYLQMNSLKT-EDTAVYYCVRHENFGNSYVSWFAHWGQGTLVTVS S (SEQ ID NO: 311) and a light chain variable region having an amino acid sequence that is at least 90% identical to the amino acid sequence shown in (SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL, characterized by an affinity for CD3 ($K_D$) of about 100 nM or less; (b) a heavy chain variable region having an amino acid sequence that is at least 90% identical to the amino acid sequence shown in EVQLVESGGGIVQPGGSLRLS-CAASGFTFSTYAMNWVRQAPGKGLEWVGRIRTKRN-NYATYY ADSVKGRFTISRDDSKNTVYLQMNSLKT-EDTAVYYCVRHENFGNSYVSWFAHWGQGTLVTVS S (SEQ ID NO: 311) and a light chain variable region having an amino acid sequence that is at least 90% identical to the amino acid sequence shown in ELVVTQEPSLTVSPGGTVTLTCRSSN-GAVTSSNYANWVQQKPGQAPRGLIGGTNKRAPGTPA RFSGSLLGGKAALTLSGVQPEDEAVYY-CALWYPNLWVFGGGTKLTVL (SEQ ID NO: 361), characterized by an affinity for CD3 ($K_D$) of about 300 nM or less; or (c) a heavy chain variable region having an amino acid sequence that is at least 90% identical to the amino acid sequence shown in EVQLVESGGGIVQPGGSLRLS-CAASGFTFSTYAMNWVRQAPGKGLEWVGRIRTKRN-NYATYY ADSVKGRFTISRDDSKNTVYLQMNSLKT-EDTAVYYCVRHENFGNSYVSWFAHWGQGTLVTVS S (SEQ ID NO: 311) and a light chain variable region having an amino acid sequence that is at least 90% identical to the amino acid sequence shown in (SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL, characterized by an affinity for CD3 ($K_D$) of about 75 nM or less.

The present disclosure provides an isolated antibody or antigen-binding fragment thereof, which specifically binds PSMA, comprising a VHH domain comprising three VHH CDRs, wherein the three VHH CDRs comprise the CDR1, CDR2 and CDR3 from QVQLVESGGGVVQPGRSLRLS-CAASGRTFGIYVWGWFRQAPGKEREFVGAMSWSG-SNRKV SDSVKGRFTISRDNSKNTLYLQMNSLRAED-TAVYYCAASNKEYGRTWYDFNESDYWGQGTQ VTVSS (SEQ ID NO: 549), wherein the CDRs are identified by the Kabat definition, the Chothia definition, the AbM definition, the IMGT definition, or the contact definition.

Included herein is an antigen binding protein comprising: (i) a VHH domain comprising an amino acid sequence at least 90%, 95%, 96%, 97%, 98%, or 99% identical to, or 100% identical to, a VHH CDR sequence selected from the group consisting of GRTFGIYVWG (SEQ ID NO:9003), AMSWSGSNRK (SEQ ID NO:9015), and AASN-KEYGRTWYDFNESDY (SEQ ID NO:9005), wherein the antigen binding protein specifically binds to PSMA.

Included herein is an isolated antibody or antigen-binding fragment thereof, which specifically binds PSMA comprising the amino acid sequence of KSSNEAT-NITPKHNMKAFLDELKAENIKKFLY-NFTQIPHLAGTEQNFQLAKQIQSQWKEFGLDSV ELAHYDVLLSYPNKTHPNYISIINEDGNEIFNT-SLFEPPPPGYENVSDIVPPFSAFSPQGMPEGD LVYVN-YARTEDFFKLERDMKINCSGKIVI-ARYGKVFRGNKVKNAQLAGAKGVILYSDPADYFAP GVKSYPDGWNLPGGGVQRGNILNLN-GAGDPLTPGYPANEYAYRRGIAEAVGLPSIPVHPIGYY DAQKLLEKMGGSAPPDSS-WRGSLKVPYNVGPGFTGNFSTQKVKMHIHST-NEVTRIYNVIGTLR GAVEPDRYVILGGHRDSWVFG-GIDPQSGAAVVHEIVRSFGTLKKEGWRPRRTILF-ASWDAEEF GLLGSTEWAEENSRLLQERGVAYI-NADSSIEGNYTLRVDCTPLMYSLVHNLTKELKSPDE-GFEG KSLYESWTKKSPSPEFSGMPRISKLGSGNDFE-VFFQRLGIASGRARYTKNWETNKFSGYPLYH SVY-ETYELVEKFYDPMFKYHLTVAQVRGGMVFELAN-SIVLPFDCRDYAVVLRKYADKIYSISMK HPQEMK-TYSVSFDSLFSAVKNFTEIASKFSERLQDFDKSNPI-VLRMMNDQLMFLERAFIDPLGL PDRPFYRHVI-YAPSSHNKYAGESFPGIYDALFDIESKVDPSKAW-GEVKRQIYVAAFTVQAAAET LSEVA (SEQ ID NO: 1044), comprising a VHH region comprising three VHH CDRs from QVQLVESGGGVVQPGRSLRLSCAAS-GRTFGIYVWGWFRQAPGKEREFVGAMSWSGSNRKV SDSVKGRFTISRDNSKNTLYLQMNSLRAEDTAVYY-CAASNKEYGRTWYDFNESDYWGQGTQ VTVSS (SEQ ID NO: 549). In some embodiments, the VHH CDR1 comprises GRTFGIYVWG (SEQ ID NO:9003), the VHH CDR2 comprises AMSWSGSNRK (SEQ ID NO:9015), and the VHH CDR3 comprises AASNKEYGRTWYDFNESDY (SEQ ID NO:9005). In some embodiments, the VHH region comprises (SEQ ID NO: 549)
QVQLVESGGGWVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

In some embodiments, included herein is an antibody or antigen-binding fragment thereof, that specifically binds PSMA (e.g., a protein having the amino acid sequence of SEQ ID NO: 549) with a $K_D$ of about 300 nM or less, e.g., as measured by surface plasmon resonance. In some embodiments, the antibody or antigen-binding portion thereof exhibits a $K_D$ of about 200 nM or less, about 150 or less, about 100 nM or less, or about 50 nM or less.

Provided herein is an antibody or antigen-binding fragment thereof, that specifically binds PSMA (e.g., a protein comprising the amino acid sequence of SEQ ID NO: 549), comprising (a) a VHH region having an amino acid sequence that is at least 95% identical to the amino acid sequence shown in QVQLVESGGGVVQPGRSLRLS-CAASGRTFGIYVWGWFRQAPGKEREFVGAMSWSG-SNRKV SDSVKGRFTISRDNSKNTLYLQMNSLRAED-TAVYYCAASNKEYGRTWYDFNESDYWGQGTQ VTVSS (SEQ ID NO: 549), characterized by an affinity for PSMA ($K_D$) of about 100 nM or less; (b) a VHH region having an amino acid sequence that is at least 95% identical to the amino acid sequence shown in QVQLVES-GGGVVQPGRSLRLSCAAS-GRTFGIYVWGWFRQAPGKEREFVGAMSWSGSNRKV SDSVKGRFTISRDNSKNTLYLQMNSLRAEDTAVYY-CAASNKEYGRTWYDFNESDYWGQGTQ VTVSS (SEQ ID NO: 549), characterized by an affinity for PSMA ($K_D$) of about 300 nM or less; or (c) a VHH region having an amino acid sequence that is at least 95% identical to the amino acid sequence shown in QVQLVESGGGVVQPGRSLRLS-CAASGRTFGIYVWGWFRQAPGKEREFVGAMSWSG-SNRKV SDSVKGRFTISRDNSKNTLYLQMNSLRAED-TAVYYCAASNKEYGRTWYDFNESDYWGQGTQ VTVSS (SEQ ID NO: 549) characterized by an affinity for PSMA ($K_D$) of about 50 nM or less.

The present disclosure includes a bispecific T cell engager comprising (i) an antibody or antigen-binding fragment thereof, that specifically binds human CD3 (a protein having a heavy chain variable region amino acid sequence of SEQ ID NO: 311 and a light chain variable region amino acid sequence of SEQ ID NO: 361) provided herein; and (ii) an antibody or antigen-binding fragment thereof, that specifically binds human PSMA (SEQ ID NO: 549) provided herein.

Various features of this disclosure are set forth with particularity in the appended claims. A better understanding of the features and advantages of the present disclosure will be obtained by reference to the following detailed description that sets forth illustrative embodiments, in which the principles of the invention are utilized, and the accompanying drawings.

BRIEF DESCRIPTION OF THE DRAWINGS

FIG. 2A depicts the concentrations of PMSA.2 variant antibodies. FIG. 2B depicts relative binding to PSMA of PMSA.2 variant antibodies. FIG. 2C depicts the thermal stability of PMSA.2 variant antibodies as measured by monomer concentration (pM) at 62° C. FIG. 2D depicts the thermal stability of PMSA.2 variant antibodies as measured by monomer concentration (pM) at 65° C. The AC clone numbers of the tested uTCEs are shown in the figures. uTCEs rather than paTCEs were used in these experiments.

FIG. 3A-FIG. 3C depict biophysical characterization data of PMSA.3 variant antibodies. FIG. 3A depicts relative binding to PSMA of PMSA.3 variant antibodies. FIG. 3B and FIG. 3C depict the thermal stability of PMSA.3 variant antibodies as measured by monomer concentration (FIG. 3B) or aggregate concentration (FIG. 3C) (pM) at 63.5° C. The AC clone numbers of the tested uTCEs are shown in the figures. uTCEs rather than paTCEs were used in these experiments.

FIG. 7A depicts an alignment of the RSR-2295 and RSR-3213 amino acid sequences and proteases capable of cleaving them.

FIG. 8A and FIG. 8B depict relative plasma stability of paTCEs employing RSR-2295 or RSR-3213, measured at Day 0 and Day 7. In FIG. 8A, RSR-2295 employed the SCy5.5 fluorophore and RSR-3213 employed the SCy7.5 fluorophore. In FIG. 8B, the RSR-2295 employed the SCy7.5 fluorophore and RSR-3213 employed the SCy5.5 fluorophore.

FIG. 13A depicts the assay results from Donor 1. FIG. 13B depicts similar results from Donors 2-5.

FIG. 14A depicts the assay results from Donor 1. FIG. 14B depicts similar results from Donors 2 and 3.

DETAILED DESCRIPTION

Figure 1A:
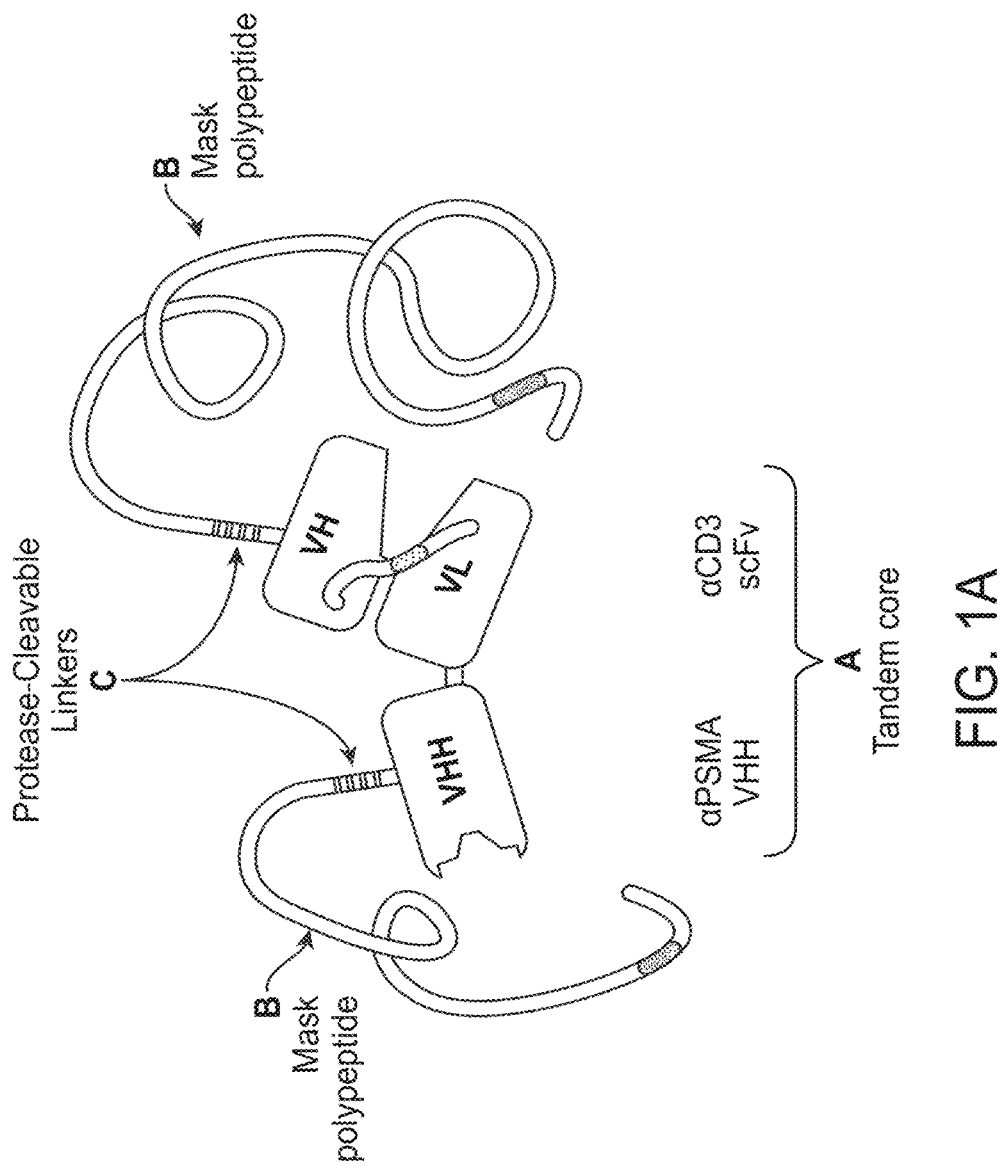
FIG. 1A depicts a non-limiting schematic representation of an exemplary paTCE.
Figure 1B:
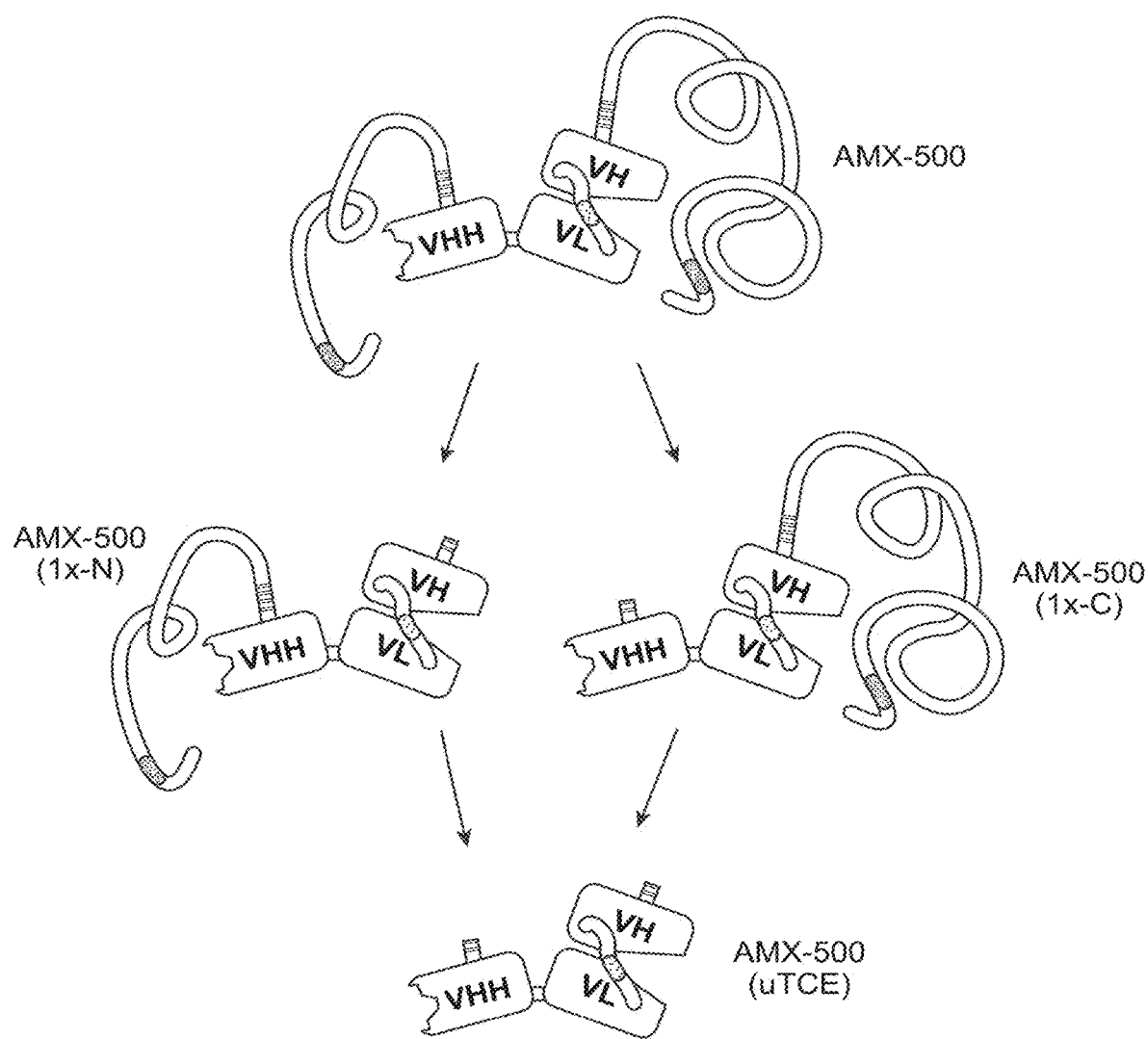
FIG. 1B depicts a schematic representation of fully unmasked paTCE (a uTCE) and singly masked metabolites paTCE(1x-N) and paTCE(1x-C) from an exemplary paTCE as shown in FIG. 1A.

There is a significant unmet need in cancer therapeutics for a PSMA-targeted bispecific treatment modality that is efficacious against solid tumors, particularly solid tumors that are present in an immunologically cold microenvironment. While TCEs have been shown to be effective in inducing remission in certain cancers, they have not led to the development of widespread therapeutics due to their extreme potency and on target, off tumor toxicities in healthy tissues.

Without being bound by any scientific theory, TCEs form a bridge between T cells and tumor cells and activate T cell-mediated killing of the tumor cells and further initiating a cytokine amplification cascade. The cytokine amplification cascade can promote further killing of tumor cells and potentially provide long term immunity. T cells activated by TCEs release cytolytic perforin/granzymes in a manner that is independent of antigen-MHC recognition. This creates a two-fold response: direct tumor cell death and amplification of tumor killing through initiation of a powerful cytokine response from the tumor cells. The direct tumor cell death results in release of tumor antigens. The cytokine response may include, among others, increased interferon-g which stimulates CD8 T cell activity and stimulates antigen presentation by APCs; increased IL2 which causes increased proliferation of activated T-cells, and increased CXCL9 and 10 response which increases T cell recruitment. Together the release of tumor antigens and the initiation of the cytokine response results in activation of the endogenous T cell response which potentially causes epitope spreading to induce long term immunity.

One toxicity challenge with TCEs arises out the fact that many tumor targets are, to some extent, also expressed in healthy tissue, and normal cells also can produce the cytokines response resulting in cytokine release syndrome (CRS). These two powerful responses of health tissue to T cell activation by TCEs often results in an overall lack of acceptable therapeutic index for these agents.

The present disclosure provides protease-activatable TCEs (paTCEs) that address an unmet need and are superior in one or more aspects including enhanced terminal half-life, targeted delivery, and/or improved therapeutic ratio with reduced toxicity to healthy tissues compared to conventional antibody therapeutics or bispecific antibody therapeutics that are active upon injection.

Included herein are compounds, compositions and methods that overcome the drawbacks in the existing TCEs by providing paTCEs that target PSMA (referred to herein as PSMA-paTCEs and exemplified as AMX-500).

AMX-500 comprises the amino acid sequence set forth as SEQ ID NO: 1000. Without being bound by any scientific theory, the paTCEs described herein are understood to exploit the dysregulated protease activity present in tumors vs. healthy tissues, enabling expansion of the therapeutic index. The paTCE core comprises antigen binding domains; one targets CD3 and the other targets PSMA. The two antigen binding domains may, in exemplary embodiments, be in two different antibody formats (such as, e.g., a single chain antibody fragment (scFv) and a VHH), or the same antibody format (such as, e.g., scFvs). Many different antibody fragments or formats may be used.

In some embodiments, a PSMA-targeting paTCE comprises a first portion that is a VHH that binds to PSMA and a second portion that is an scFv that binds to CD3. One or more (e.g., two) unstructured polypeptide masks are attached to the core. In some embodiments, these unstructured polypeptide masks sterically reduce target engagement of either the tumor target and/or CD3, and also extend protein half-life. In some embodiments, the unstructured polypeptide masks are extended length non-natural polypeptides (ELNNs).

In some embodiments, the properties of ELNNs also minimize the potential for immunogenicity, as their lack of stable tertiary structures disfavors antibody binding, and the absence of hydrophobic, aromatic, and positively charged residues that serve as anchor residues for peptide MHC II binding reduces the potential for T cell epitopes.

In some embodiments, protease cleavage sites at the base of the ELNN or ELNNs enable proteolytic activation of paTCEs in the tumor microenvironment, unleashing a smaller, highly potent TCEs that are capable redirecting cytotoxic T cells to kill target-expressing tumor cells. In some embodiments, in healthy tissues, where protease activity is tightly regulated, paTCEs remain predominantly inactive, thus expanding the therapeutic index compared to unmasked TCEs.

In some embodiments, in addition to localized activation, the short half-life of the unmasked TCE form further widens the therapeutic index while providing the potency of T-cell immunity to improve the eradication of solid tumors. In some embodiments, the release sites used in the paTCEs can be cleaved across a broad array of tumors by proteases that are collectively involved in every cancer hallmark (growth; survival and death; angiogenesis; invasion and metastasis; inflammation; and immune evasion). Thus, TCE activity of the paTCEs is localized to tumors by exploiting the enhanced protease activity that is upregulated in all stages of cancer and tumor development but is tightly regulated in healthy tissues.

Terminology

As used herein, the following terms have the meanings ascribed to them unless specified otherwise.

As used in the specification and claims, the singular forms "a," "an," and "the" include plural references unless the context clearly dictates otherwise. For example, the term "a cell" includes a plurality of cells, including mixtures thereof, unless the context clearly dictates otherwise.

Furthermore, "and/or" where used herein is to be taken as specific disclosure of each of the two specified features or components with or without the other. Thus, the term "and/or" as used in a phrase such as "A and/or B" herein is intended to include "A and B," "A or B," "A" (alone), and "B" (alone). Likewise, the term "and/or" as used in a phrase such as "A, B, and/or C" is intended to encompass each of the following aspects: "A, B, and C"; "A, B, or C"; "A or C"; "A or B"; "B or C"; "A and C"; "A and B"; "B and C"; "A" (alone); "B" (alone); and "C" (alone).

It is understood that wherever aspects are described herein with the language "comprising," otherwise analogous aspects described in terms of "consisting of" and/or "consisting essentially of" are also provided.

Numeric ranges are inclusive of the numbers defining the range. Unless otherwise indicated, amino acid sequences are written left to right in amino to carboxy orientation. The headings provided herein are not limitations of the various aspects of the disclosure. Accordingly, the terms defined immediately below are more fully defined by reference to the specification in its entirety.

The term "about" is used herein to mean approximately, roughly, around, or in the regions of. When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower). In some embodiments, the term indicates deviation from the indicated numerical value by ±10%, ±5%, 4%, 3%, 2%, 1%, 0.9%, ±0.8%, 0.7%, 0.6%, 0.5%, 0.4%, 0.3%, 0.2%, 0.1%, 0.05%, or +0.01%. In some embodiments, "about" indicates deviation from the indicated numerical value by ±10%. In some embodiments, "about" indicates deviation from the indicated numerical value by ±5%. In some embodiments, "about" indicates deviation from the indicated numerical value by ±4%. In some embodiments, "about" indicates deviation from the indicated numerical value by ±3%. In some embodiments, "about" indicates deviation from the indicated numerical value by ±2%. In some embodiments, "about" indicates deviation from the indicated numerical value by ±1%. In some embodiments, "about" indicates deviation from the indicated numerical value by ±0.9%. In some embodiments, "about" indicates deviation from the indicated numerical value by ±0.8%. In some embodiments, "about" indicates deviation from the indicated numerical value by ±0.7%. In some embodiments, "about" indicates deviation from the indicated numerical value by ±0.6%. In some embodiments, "about" indicates deviation from the indicated numerical value by ±0.5%. In some embodiments, "about" indicates deviation from the indicated numerical value by ±0.4%. In some embodiments, "about" indicates deviation from the indicated numerical value by ±0.3%. In some embodiments, "about" indicates deviation from the indicated numerical value by ±0.1%. In some embodiments, "about" indicates deviation from the indicated numerical value by ±0.05%. In some embodiments, "about" indicates deviation from the indicated numerical value by ±0.01%.

With respect to naturally occurring compounds, the term "isolated" refers to a compound (i.e., a polypeptide or polynucleotide) that is not in its native state (e.g., free to varying degrees from components that naturally accompany the compound in nature). No particular level of purification is required. For example, an isolated polypeptide can simply be removed from its native or natural environment. Recombinantly produced polypeptides and proteins expressed in host cells are considered isolated for the purpose of the disclosure, as are native or recombinant polypeptides which have been separated, fractionated, or partially or substantially purified by any suitable technique. "Isolate" and "isolated" may also denote a degree of separation from an original source or surrounding, depending on context.

The term "polypeptide" refers to any polymer of two or more amino acids. Thus, the terms peptide, dipeptide, tripeptide, oligopeptide, protein, amino acid chain, or any other term used to refer to a chain of two or more amino acids, is included within the definition of "polypeptide." The term "polypeptide" also encompasses an amino acid polymer that has been modified (e.g., by post-translational modification), for example, by disulfide bond formation, glycosylation, lipidation, acetylation, phosphorylation, or any other manipulation, such as conjugation with a labeling component. Depending on context, the term "polypeptide" may also be used to refer to a protein comprising two or more polymers of two or more amino acids.

A "host cell" includes an individual cell (e.g., in culture) which that comprises an exogenous polynucleotide. Host cells may include progeny of a single host cell. The progeny may not necessarily be completely identical (in morphology or in genomic of total DNA complement) to the original parent cell due to naturally occurring or genetically engineered variation.

A "fusion" or "chimeric" polypeptide or protein comprises a first polypeptide portion linked to a second polypeptide portion with which it is not naturally linked in nature. In some embodiments, the portions may normally exist in separate proteins and are brought together in the fusion polypeptide; they may normally exist in the same protein but are placed in a new arrangement in the fusion polypeptide; or the portions may be brought together from different sources. In some embodiments, a fusion or chimeric protein comprises two or more moieties that do not occur in nature (e.g., are created, designed, or otherwise generated by humans, such as binding domains, masks, linkers, barcodes, and other polypeptides provided herein). A chimeric protein may be created, for example, by chemical synthesis, or by recombinant expression (e.g., comprising creating and translating a polynucleotide in which the peptide regions are encoded in the desired relationship).

"Conjugated", "linked," "fused," and "fusion" may be used interchangeably herein, depending on context. These terms may refer to the covalent joining together of two more chemical (e.g., polypeptide) elements or components, by whatever means including chemical conjugation or recombinant means.

As known in the art, "sequence identity" between two polypeptides is determined by comparing the amino acid sequence of one polypeptide to the sequence of a second polypeptide. Similarly, "sequence identity" between two polynucleotides is determined by comparing the nucleotide sequence of one polynucleotide to the sequence of a second polynucleotide. The terms "% identical", "% identity" or similar terms are intended to refer, in particular, to the percentage of nucleotides or amino acids (as applicable) which are identical in an optimal alignment between the sequences to be compared. Said percentage may be purely statistical, and the differences between the two sequences may be but are not necessarily randomly distributed over the entire length of the sequences to be compared. Comparisons of two sequences are usually carried out by comparing the sequences, after optimal alignment, with respect to a segment or "window of comparison", in order to identify local regions of corresponding sequences. For example, the optimal alignment for a comparison may be carried out manually or with the aid of the local homology algorithm by Smith and Waterman, 1981, Ads App. Math. 2, 482, with the aid of the local homology algorithm by Neddleman and Wunsch, 1970, J. Mol. Biol. 48, 443, with the aid of the similarity search algorithm by Pearson and Lipman, 1988, Proc. Natl Acad. Sci. USA 88, 2444, or with the aid of computer programs using the algorithms (GAP, BESTFIT, FASTA, BLAST P, BLAST N and TFASTA in Wisconsin Genetics Software Package, Genetics Computer Group, 575 Science Drive, Madison, Wis.). In some embodiments, percent identity of two sequences is determined using the BLASTN or BLASTP algorithm, as available on the United States National Center for Biotechnology Information (NCBI) website (e.g., at blast.ncbi.nlm.nih.gov. In some embodiments, the algorithm parameters used for BLASTN algorithm on the NCBI website include: (i) Expect Threshold set to 10; (ii) Word Size set to 28; (iii) Max matches in a query range set to 0; (iv) Match/Mismatch Scores set to 1, −2; (v) Gap Costs set to Linear; and (vi) the filter for low complexity regions being used. In some embodiments, the algorithm parameters used for BLASTP algorithm on the NCBI website include: (i) Expect Threshold set to 10; (ii) Word Size set to 3; (iii) Max matches in a query range set to 0; (iv) Matrix set to BLOSUM62; (v) Gap Costs set to Existence: 11 Extension: 1; and (vi) conditional compositional score matrix adjustment. When discussed herein, whether any particular polypeptide is at least about 50%, 60%, 70%, 75%, 80%, 85%, 90%, 95%, 99%, or 100% identical to another polypeptide can be determined using methods and computer programs/software known in the art such as, but not limited to, the BESTFIT program (Wisconsin Sequence Analysis Package, Version 8 for Unix, Genetics Computer Group, University Research Park, 575 Science Drive, Madison, WI 53711). BESTFIT uses the local homology algorithm of Smith and Waterman, Advances in Applied Mathematics 2:482-489 (1981), to find the best segment of homology between two sequences. When using BESTFIT or any other sequence alignment program to determine whether a particular sequence is, for example, 95% identical to a reference sequence according to the present disclosure, the parameters are set, of course, such that the percentage of identity is calculated over the full-length of the reference polypeptide sequence and that gaps in homology of up to 5% of the total number of amino acids in the reference sequence are allowed.

As used herein, the terms "mask polypeptide", "mask", and "masking moiety" refer to a polypeptide that is capable of reducing the binding of an antigen binding domain (e.g., an antibody) to the target antigen in the context of a fusion protein (such as a chimeric polypeptide) provided herein. Exemplary mask polypeptides include, but are not limited to, the ELNN polypeptides described herein. Additional mask polypeptides include albumin, polypeptides consisting of proline, serine and alanine, coiled-coil domains, albumin binding domains, Fc domains, and binding domains with specificity to conserved regions of an antibody variable domain. Mask polypeptides are described in further detail in Lucchi et al. (ACS Cent Sci. 2021 May 26; 7(5): 724-738).

As used herein, the terms "ELNN polypeptides" and "ELNNs" are synonymous and refer to extended length polypeptides comprising non-naturally occurring, substantially non-repetitive sequences (e.g., polypeptide motifs) that are composed mainly of small hydrophilic amino acids, with the sequence having a low degree or no secondary or tertiary structure under physiologic conditions. ELNN polypeptides include unstructured hydrophilic polypeptides comprising repeating motifs of 6 natural amino acids (G, A, P, E, S, and/or T). In some embodiments, an ELNN polypeptide comprises multiple motifs of 6 natural amino acids (G, A, P, E, S, T), wherein the motifs are the same or comprise a combination of different motifs. In some embodiments, ELNN polypeptides can confer certain desirable pharmacokinetic, physicochemical, and pharmaceutical properties when linked to proteins, including T-cell engagers as disclosed herein. Such desirable properties may include but are not limited to enhanced pharmacokinetic parameters and solubility characteristics, as well as improved therapeutic index. ELNN polypeptides are known in the art, and non-limiting descriptions relating to and examples of ELNN polypeptides known as XTEN® polypeptides are available in Schellenberger et al., (2009) *Nat Biotechnol* 27(12):1186-90; Brandl et al., (2020) *Journal of Controlled Release* 327:186-197; and Radon et al., (2021) *Advanced Functional Materials* 31, 2101633 (pages 1-33), the entire contents of each of which are incorporated herein by reference.

In some embodiments, the repetitiveness of an ELNN sequence refers to the 3-mer repetitiveness and can be measured by computer programs or algorithms or by other means known in the art. In some embodiments, the 3-mer repetitiveness of an ELNN may be assessed by determining the number of occurrences of the overlapping 3-mer sequences within the polypeptide. For example, a polypeptide of 200 amino acid residues has 198 overlapping 3-amino acid sequences (3-mers), but the number of unique 3-mer sequences will depend on the amount of repetitiveness within the sequence. In some embodiments, the score can be generated (hereinafter "subsequence score") that is reflective of the degree of repetitiveness of the 3-mers in the overall polypeptide sequence. In this context, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 73 of International Patent Application Publication No. WO 2010/091122 A1, which is incorporated by reference in its entirety.

In some embodiments, and in the context of ELNNs, a "substantially non-repetitive sequence," refers to an ELNN sequence, wherein (1) there are few or no instances of four identical amino acids in a row in the ELNN sequence and wherein (2) the ELNN has a subsequence score (defined in the preceding paragraph herein) of 12, or 10 or less or that there is not a pattern in the order, from N- to C-terminus, of the sequence motifs that constitute the polypeptide sequence.

A "vector" is a nucleic acid molecule that transfers an inserted nucleic acid molecule into and/or between host cells. In some embodiments, a vector self-replicates in an appropriate host. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be used for the transcription of mRNA that is translated into a polypeptide(s). In some embodiments, an "expression system" is a suitable host cell comprising an expression vector that can function to yield a desired expression product. The terms "treatment" or "treating," and "ameliorating" may be used interchangeably herein. These terms refer to an approach for obtaining beneficial or desired results including but not limited to a therapeutic benefit. By "therapeutic benefit" is meant eradication or amelioration of the underlying disorder being treated. In some embodiments, a therapeutic benefit is achieved with the eradication or amelioration of one or more of the physiological symptoms associated with the underlying disease condition such that an improvement is observed in the subject, notwithstanding that the subject may still be afflicted with the underlying disorder. In some embodiments, a therapeutic benefit comprises slowing or halting the growth of one or more tumors. In some embodiments, a therapeutic benefit comprises reducing the size of one or more tumors. In some embodiments, a therapeutic benefit comprises eradicating one or more tumors from a subject. In some embodiments, a therapeutic benefit comprises effecting the death of cancer cells.

As used herein, the term "therapeutically effective amount" refers to an amount of a biologically active agent (such as a fusion protein provided herein, e.g., as part of a pharmaceutical composition), that is capable of having any detectable, beneficial effect on any symptom, aspect, measured parameter or characteristics of a disease state or condition when administered in one or repeated doses to a subject. Such effect need not be absolute to be beneficial. The disease condition can refer to a disorder or a disease, e.g., cancer or a symptom of cancer.

Antigen Binding Domains, Cleavage Sequences, Barcode Fragments, and Fusion Polypeptides The present disclosure provides, inter alia, new and useful anti-PSMA antibodies, new and useful anti-CD3 antibodies, cleavage sequences, barcode fragments, and fusion proteins comprising the same. Included herein are fusion polypeptides comprising (i) one or more mask polypeptides (such as ELNNs), (ii) a bispecific antibody (BsAb, e.g., a TCE) linked to the mask polypeptide(s), and (iii) one or more protease-cleavable release segments (RS), wherein an RS is positioned between the mask polypeptide(s) and the BsAb.

In some embodiments, anti-PSMA antibodies provided herein include a VHH domain comprising the CDRs of a VHH domain comprising the sequence:

(SEQ ID NO: 549)
QVQLVESGGGWVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

In some embodiments, anti-CD3 antibodies provided herein comprise a VH domain comprising the CDRs of a VH domain comprising the sequence:

(SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS and/or a VL domain comprising the CDRs of a VL domain comprising the sequence:

(SEQ ID NO: 361)
ELVVTQEPSLTVSPGGTVTLTCRSSNGAVTSSNYANWVQQKPGQAPRGL

IGGTNKRAPGTPARFSGSLLGGKAALTLSGVQPEDEAVYYCALWYPNLW

VFGGGTKLTVL.

Also provided are BsAbs comprising, e.g., anti-PSMA antibodies and/or anti-CD3 antibodies disclosed herein. In some embodiments, the bispecific antibodies comprise an anti-PSMA VHH region disclosed herein. In some embodiments, the BsAbs comprise the VH and VL regions of an anti-CD3 antibody disclosed herein. In some embodiments, the BsAbs comprise an anti-PSMA VHH region herein and an anti-CD3 scFV comprising a VH and VL pair disclosed herein. In some embodiments, the BsAbs are TCEs.

In some embodiments, the fusion polypeptide comprises a first ELNN (such as an ELNN described herein). In some embodiments, the polypeptide further comprises a second ELNN (such as an ELNN described herein). In some embodiments, the polypeptide comprises an ELNN at or near its N-terminus (an "N-terminal ELNN"). In some embodiments, the polypeptide comprises an ELNN at or near its C-terminus (a "C-terminal ELNN"). In some embodiments, the polypeptide comprises both an N-terminal ELNN and a C-terminal ELNN.

In some embodiments, a fusion polypeptide comprises a BsAb and a first ELNN is attached to the N-terminus of the BsAb by a first RS and a second ELNN is attached to the C-terminus of the BsAb by a second RS. In some embodiments, each RS is cleavable by a protease mentioned herein. In some embodiments, each RS comprises an RS sequence disclosed herein. In some embodiments, the fusion polypeptide is a paTCE.

Included herein are polypeptide sequences that may be used, e.g., to link one polypeptide moiety to another within a fusion protein. For example, useful linkers are provided that are cleaved by multiple proteases but not legumain. In some embodiments, such linkers may be used outside the context of antibodies such as those described herein.

In some embodiments, a fusion polypeptide (e.g., one or more ELNNs of a paTCE and/or another portion of a fusion polypeptide such as a linker or spacer sequence) can comprise one or more barcode fragments (e.g., as described herein) releasable (e.g., configured to be released) the fusion polypeptide upon cleavage or digestion of the fusion polypeptide (e.g., a paTCE) by a protease. In some embodiments, the protease is a non-mammalian protease. In some embodiments, each barcode fragment differs in sequence and molecular weight from all other peptide fragments (including all other barcode fragments if present) that are releasable from the polypeptide upon complete digestion of the polypeptide by the protease, thereby making it unique and making its presence detectable through techniques such as mass spectrometry.

Extended Recombinant Polypeptides (ELNNS)

Chain Length and Amino Acid Composition

In some embodiments, an ELNN comprises at least 100, or at least 150 amino acids. In some embodiments, an ELNN is from 100 to 3,000, or from 150 to 3,000 amino acids in length. In some embodiments, an ELNN is from 100 to 1,000, or from 150 to 1,000 amino acids in length. In some embodiments, an ELNN is at least (about) 100, at least (about) 150, at least (about) 200, at least (about) 250, at least (about) 300, at least (about) 350, at least (about) 400, at least (about) 450, at least (about) 500, at least (about) 550, at least (about) 600, at least (about) 650, at least (about) 700, at least (about) 750, at least (about) 800, at least (about) 850, at least (about) 900, at least (about) 950, at least (about) 1,000, at least (about) 1,100, at least (about) 1,200, at least (about) 1,300, at least (about) 1,400, at least (about) 1,500, at least (about) 1,600, at least (about) 1,700, at least (about) 1,800, at least (about) 1,900, or at least (about) 2,000 amino acids in length. In some embodiments, an ELNN is at most (about) 100, at most (about) 150, at most (about) 200, at most (about) 250, at most (about) 300, at most (about) 350, at most (about) 400, at most (about) 450, at most (about) 500, at most (about) 550, at most (about) 600, at most (about) 650, at most (about) 700, at most (about) 750, at most (about) 800, at most (about) 850, at most (about) 900, at most (about) 950, at most (about) 1,000, at most (about) 1,100, at most (about) 1,200, at most (about) 1,300, at most (about) 1,400, at most (about) 1,500, at most (about) 1,600, at most (about) 1,700, at most (about) 1,800, at most (about) 1,900, or at most (about) 2,000 amino acids in length. In some embodiments, an ELNN has (about) 100, (about) 150, (about) 200, (about) 250, (about) 300, (about) 350, (about) 400, (about) 450, (about) 500, (about) 550, (about) 600, (about) 650, (about) 700, (about) 750, (about) 800, (about) 850, (about) 900, (about) 950, (about) 1,000, (about) 1,100, (about) 1,200, (about) 1,300, (about) 1,400, (about) 1,500, (about) 1,600, (about) 1,700, (about) 1,800, (about) 1,900, or (about) 2,000 amino acids in length, or of a range between any two of the foregoing. In some embodiments, at least 90% of the amino acid residues of the ELNN are glycine (G), alanine (A), serine (S), threonine (T), glutamate (E) or proline (P). In some embodiments, at least 91%, 92%, 93%, 94%, 95%, 96%, 97%, 98%, 99% or 100% of the amino acid residues of the ELNN are glycine (G), alanine (A), serine (S), threonine (T), glutamate (E) or proline (P). In some embodiments, an ELNN comprises at least 3 different types of amino acids selected from the group consisting of G, A, S, T, E, and P. In some embodiments, an ELNN comprises at least 4 different types of amino acids selected from the group consisting of G, A, S, T, E, and P. In some embodiments, an ELNN comprises at least 5 different types of amino acids selected from the group consisting of G, A, S, T, E, and P. In some embodiments, an ELNN consists of amino acids selected from the group consisting of G, A, S, T, E, and P. In some embodiments, an ELNN comprises G, A, S, T, E, or P amino acids. In some embodiments, an ELNN (e.g., ELNN1, ELNN2, etc.) is characterized in that: (i) it comprises at least 100, or at least 150 amino acids; (ii) at least 90% of the amino acid residues of the ELNN are glycine (G), alanine (A), serine (S), threonine (T), glutamate (E) or proline (P); and (iii) it comprises at least 4 different types of the amino acids from G, A, S, T, E, or P. As used herein, the term "glutamate" is a synonym for "glutamic acid," and refers to the glutamic acid residue whether or not the side-chain carboxyl is deprotonated. In some embodiments, the ELNN-containing fusion polypeptide comprises a first ELNN and a second ELNN. In some embodiments, the sum of the total number of amino acids in the first ELNN and the total number of amino acids in the second ELNN is at least 300, at least 350, at least 400, at least 500, at least 600, at least 700, or at least 800 amino acids.

Non-Overlapping Sequence Motif

In some embodiments, the ELNN comprises, or is formed from, a plurality of non-overlapping sequence motifs. In some embodiments, at least one of the non-overlapping sequence motifs is recurring (or repeated at least two times in the ELNN). In some embodiments, the ELNN comprises at least one other non-overlapping sequence motif that is non-recurring (or found only once within the ELNN). In some embodiments, the plurality of non-overlapping sequence motifs comprises (a) a set of (recurring) non-overlapping sequence motifs, wherein each non-overlapping sequence motif of the set of non-overlapping sequence motifs is repeated at least two times in the ELNN; and (b) a non-overlapping (non-recurring) sequence motif that occurs (or is found) only once within the ELNN. In some embodiments, each non-overlapping sequence motif is from 9 to 14 (or 10 to 14, or 11 to 13) amino acids in length. In some embodiments, each non-overlapping sequence motif is 12 amino acids in length. In some embodiments, the plurality of non-overlapping sequence motifs comprises a set of non-overlapping (recurring) sequence motifs, wherein each non-overlapping sequence motif of the set of non-overlapping sequence motifs is (1) repeated at least two times in the ELNN; and (2) is between 9 and 14 amino acids in length. In some embodiments, the set of (recurring) non-overlapping sequence motifs comprises 12-mer sequence motifs identified herein by SEQ ID NOs: 179-200 and 1715-1722 in Table 1. In some embodiments, the set of (recurring) non-overlapping sequence motifs comprise 12-mer sequence motifs identified herein by SEQ ID NOs: 186-189 in Table 1. In some embodiments, the set of (recurring) non-overlapping sequence motifs comprise at least two, at least three, or all four of 12-mer sequence motifs of SEQ ID NOs: 186-189 in Table 1. In some embodiments, an ELNN further comprises a sequence other than a 12-mer sequence motif shown in Table 1. In some embodiments, an ELNN comprises a sequence that is not in Table 1 such as ASSAT-PESGP (SEQ ID NO:9176), GSGPGTSESATP (SEQ ID NO:9018), or GTSESATP (SEQ ID NO:9022). In some embodiments, an ELNN comprises a sequence that is not in Table 1 such as ATPESGP (SEQ ID NO:9177), GTSPSAT-PESGP (SEQ ID NO:9019), or GTSESAGEPEA. In some embodiments, an ELNN comprises a barcode sequence.

TABLE 1

Exemplary 12-Mer Sequence Motifs for Construction of ELNNs

| Motif Family* | Amino Acid Sequence | SEQ ID NO. |
|---|---|---|
| AD | GESPGGSSGSES | 182 |
| AD | GSEGSSGPGESS | 183 |
| AD | GSSESGSSEGGP | 184 |
| AD | GSGGEPSESGSS | 185 |
| AE, AM | GSPAGSPTSTEE | 186 |
| AE, AM, AQ | GSEPATSGSETP | 187 |
| AE, AM, AQ | GTSESATPESGP | 188 |
| AE, AM, AQ | GTSTEPSEGSAP | 189 |
| AF, AM | GSTSESPSGTAP | 190 |
| AF, AM | GTSTPESGSASP | 191 |
| AF, AM | GTSPSGESSTAP | 192 |
| AF, AM | GSTSSTAESPGP | 193 |
| AG, AM | GTPGSGTASSSP | 194 |
| AG, AM | GSSTPSGATGSP | 195 |
| AG, AM | GSSPSASTGTGP | 196 |

TABLE 1-continued

Exemplary 12-Mer Sequence Motifs for
Construction of ELNNs

| Motif Family* | Amino Acid Sequence | SEQ ID NO. |
|---|---|---|
| AG, AM | GASPGTSSTGSP | 197 |
| AQ | GEPAGSPTSTSE | 198 |
| AQ | GTGEPSSTPASE | 199 |
| AQ | GSGPSTESAPTE | 200 |
| AQ | GSETPSGPSETA | 179 |
| AQ | GPSETSTSEPGA | 180 |
| AQ | GSPSEPTEGTSA | 181 |
| BC | GSGASEPTSTEP | 1715 |
| BC | GSEPATSGTEPS | 1716 |
| BC | GTSEPSTSEPGA | 1717 |
| BC | GTSTEPSEPGSA | 1718 |
| BD | GSTAGSETSTEA | 1719 |
| BD | GSETATSGSETA | 1720 |
| BD | GTSESATSESGA | 1721 |
| BD | GTSTEASEGSAS | 1722 |

*Denotes individual motif sequences that, when used together in various permutations, results in a "family sequence"

Unstructured Polypeptide Confirmation

In various embodiments, an ELNN component (or the ELNN components) of a fusion protein has an unstructured conformation under physiological conditions, regardless of the length (e.g., extended length) of the polymer. For example, the ELNN is characterized by a large conformational freedom of the peptide backbone. In some embodiments, the ELNN is characterized by a lack of long-range interactions as determined by NMR. In some embodiments, the present disclosure provides ELNNs that, under physiologic conditions, resemble the structure of denatured sequences largely devoid in secondary structure. In some embodiments, the ELNNs can be substantially devoid of secondary structure under physiologic conditions. "Largely devoid," as used in this context, means that less than 50% of the ELNN amino acid residues of the ELNN contribute to secondary structure as measured or determined by the means described herein. "Substantially devoid," as used in this context, means that at least about 60%, or about 70%, or about 80%, or about 90%, or about 95%, or at least about 99% of the ELNN amino acid residues of the ELNN sequence do not contribute to secondary structure, as measured or determined by the means described herein.

A variety of methods have been established in the art to discern the presence or absence of secondary and tertiary structures in a given polypeptide. In some embodiments, ELNN secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) *Biochemistry,* 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1 (the entire contents of which are incorporated herein by reference). For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some embodiments, the ELNNs used in a fusion protein composition can have an alpha-helix percentage ranging from 0% to less than about 5% as determined by a Chou-Fasman algorithm. In some embodiments, the ELNNs of the fusion protein compositions can have a beta-sheet percentage ranging from 0% to less than about 5% as determined by a Chou-Fasman algorithm. In some embodiments, the ELNNs of the fusion protein compositions can have an alpha-helix percentage ranging from 0% to less than about 5% and a beta-sheet percentage ranging from 0% to less than about 5% as determined by a Chou-Fasman algorithm. In some embodiments, the ELNNs of the fusion protein compositions will have an alpha-helix percentage less than about 2% and a beta-sheet percentage less than about 2%. In some embodiments, the ELNNs of the fusion protein compositions can have a high degree of random coil percentage, as determined by a GOR algorithm. In some embodiments, an ELNN can have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by a GOR algorithm.

Net Charge

In some embodiments, the ELNN polypeptides can have an unstructured characteristic imparted by incorporation of amino acid residues with a net charge and/or reducing the proportion of hydrophobic amino acids in the ELNN sequence. The overall net charge and net charge density may be controlled, e.g., by modifying the content of charged amino acids in the ELNNs. In some embodiments, the net charge density of the ELNN of the compositions may be above +0.1 or below −0.1 charges/residue. In some embodiments, the net charge of a ELNN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, the ELNNs can optionally be designed to have a net negative charge to minimize non-specific interactions between the ELNN containing compositions and various surfaces such as blood vessels, healthy tissues, or various receptors. Not to be bound by a particular theory, an ELNN may adopt open conformations due to electrostatic repulsion between individual amino acids of the ELNN polypeptide that individually carry a high net negative charge and that are distributed across the sequence of the ELNN polypeptide. Such a distribution of net negative charge in the extended sequence lengths of ELNN can lead to the unstructured conformation that, in turn, can result in an effective increase in hydrodynamic radius. Accordingly, in some embodiments the ELNNs contain glutamic acid such that the glutamic acid is at about 8, 10, 15, 20, 25, or even about 30% of the amino acids in the sequences. The ELNN of the compositions of the present disclosure generally have no or a low content of positively charged amino acids. In some embodiments the ELNN may have less than about 10% amino acid residues with a positive charge, or less than about 7%, or less than about 5%, or less than about 2% amino acid residues with a positive charge. However, the present disclosure contemplates polypeptides where a limited number of amino acids with a positive charge, such as lysine, may be incorporated into an ELNN, e.g., to permit conjugation between the epsilon amine of the lysine and a reactive group on a peptide, a linker bridge, or a reactive group on a drug or small molecule to be conjugated to the ELNN backbone.

In some embodiments, an ELNN may comprise charged residues separated by other residues such as serine or glycine, which may lead to better expression or purification behavior. Based on the net charge, ELNNs of the subject compositions may have an isoelectric point (pI) of 1.0, 1.5, 2.0, 2.5, 3.0, 3.5, 4.0, 4.5, 5.0, 5.5, 6.0, or even 6.5. In some embodiments, the ELNN will have an isoelectric point between 1.5 and 4.5. In some embodiments, an ELNN incorporated into an paTCE fusion protein carries a net negative charge under physiologic conditions contributes to the unstructured conformation and reduced binding of the ELNN component to mammalian proteins and tissues.

As hydrophobic amino acids can impart structure to a polypeptide, in some embodiments the content of hydrophobic amino acids in the ELNN is less than 5%, or less than 2%, or less than 1% hydrophobic amino acid content. In some embodiments, an ELNN has no hydrophobic amino acids. In some embodiments, the amino acid content of methionine and tryptophan in the ELNN component of a paTCE fusion protein is less than 5%, or less than 2%, and most preferably less than 1%. In some embodiments, the ELNN has a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total ELNN sequence. In some embodiments, the ELNN has no methionine or tryptophan residues.

Increased Hydrodynamic Radius

In some embodiments, the ELNN can have a high hydrodynamic radius, conferring a corresponding increased Apparent Molecular Weight to the paTCE fusion protein which incorporates the ELNN. The linking of ELNNs to BsAb (e.g., TCE) sequences can result in paTCE compositions that can have increased hydrodynamic radii, increased Apparent Molecular Weight, and increased Apparent Molecular Weight Factor compared to BsAbs (e.g., TCEs) not linked to an ELNN. For example, in some therapeutic applications in which prolonged half-life is desired, one or more ELNNs with a high hydrodynamic radius are incorporated into a fusion protein comprising a BsAb (e.g., a TCE) to effectively enlarge the hydrodynamic radius of the fusion protein beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv. Drug Deliv. Rev. 55:1261-1277), resulting in reduced renal clearance of circulating proteins. In some embodiments, the hydrodynamic radius of a protein is determined by its molecular weight as well as by its structure, including shape and compactness. Not to be bound by a particular theory, the ELNN may adopt open conformations due to electrostatic repulsion between individual charges of the peptide or the inherent flexibility imparted by the particular amino acids in the sequence that lack potential to confer secondary structure. In some embodiments, the open, extended and unstructured conformation of the ELNN polypeptide has a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. In some embodiments, the addition of increasing lengths of ELNN results in proportional increases in the parameters of hydrodynamic radius, Apparent Molecular Weight, and Apparent Molecular Weight Factor, permitting the tailoring of paTCE to desired characteristic cut-off Apparent Molecular Weights or hydrodynamic radii. Accordingly, in some embodiments, the paTCE fusion protein can be configured with an ELNN such that the fusion protein can have a hydrodynamic radius of at least about 5 nm, or at least about 8 nm, or at least about 10 nm, or 12 nm, or at least about 15 nm. In some embodiments, the large hydrodynamic radius conferred by the ELNN in an paTCE fusion protein can lead to reduced renal clearance of the resulting fusion protein, leading to a corresponding increase in terminal half-life, an increase in mean residence time, and/or a decrease in renal clearance rate.

In some embodiments, an ELNN (or multiple ELNNs, such as two ELNNs) of a chosen length and sequence can be selectively incorporated into a paTCE to create a fusion protein that will have, under physiologic conditions, an Apparent Molecular Weight of at least about 150 kDa, or at least about 300 kDa, or at least about 400 kDa, or at least about 500 kDa, or at least about 600 kDa, or at least about 700 kDa, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In some embodiments, an ELNN (or multiple ELNNs, such as two ELNNs) of a chosen length and sequence can be selectively linked to a BsAb (e.g., a TCE) to result in a paTCE fusion protein that has, under physiologic conditions, an Apparent Molecular Weight Factor of at least 3, alternatively of at least 4, alternatively of at least 5, alternatively of at least 6, alternatively of at least 7, alternatively of at least 8, alternatively of at least 9, alternatively of at least 10, alternatively of at least 15, or an Apparent Molecular Weight Factor of at least 20 or greater. In some embodiments, the paTCE fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein. In some embodiments, the fusion polypeptide exhibits an apparent molecular weight factor under physiological conditions that is greater than about 6.

Increased Terminal Half-Life

In some embodiments, a fusion polypeptide comprising an ELNN (such as a paTCE) has a terminal half-life that is at least two-fold longer, or at least three-fold longer, or at least four-fold longer, or at least five-fold longer, compared to a corresponding biologically active polypeptide that is not linked to the ELNN. In some embodiments, the (fusion)

polypeptide has a terminal half-life that is at least two-fold longer compared to the biologically active polypeptide not linked to the ELNN.

In some embodiments, administration of a therapeutically effective amount of a paTCE fusion protein to a subject in need thereof results in a gain in time of at least two-fold, or at least three-fold, or at least four-fold, or at least five-fold or more spent within a therapeutic window for the fusion protein compared to the corresponding BsAb (e.g., TCE) not linked to the ELNN(s) when administered at a comparable dose to a subject.

In some embodiments, a TCE released from a paTCE upon protease cleavage comprises one or more short polypeptides (e.g., about 30, 25, 20, 15, 14, 13, 12, 11, 10, or less amino acids in length) that has no amino acids other than G, A, P, E, S, and/or T. For example, a short polypeptide that has no amino acids other than G, A, P, E, S, and/or T might be incorporated into one or more spacer or linker sequences of the TCE, and/or a portion of one or more spacers or linkers that remain part of the TCE after cleavage. In some embodiments, a TCE that is released from a paTCE comprises a GTSESATPES (SEQ ID NO:96) on the N-terminal side (e.g., the closest amino acid of the sequence is within 10, 9, 8, 7, 6, 5, 4, 3, 2, or 1 amino acid positions of the N-terminal amino acid or the sequence includes the N-terminus) of the TCE. In some embodiments, a TCE that is released from a paTCE comprises a GTATPESGPG (SEQ ID NO:97) on the C-terminal side (e.g., the closest amino acid of the sequence is within 10, 9, 8, 7, 6, 5, 4, 3, 2, or 1 amino acid positions of the N-terminal amino acid or the sequence includes the N-terminus) of the TCE. In some embodiments, a TCE comprises an internal linker (e.g., between a VL region and a VH region of a scFV) that comprises a polypeptide sequence with no amino acids other than G, A, P, E, S, and/or T, such as SESATPESGPGTSP-GATPESGPGTSESATP (SEQ ID NO: 81).

Low Immunogenicity

In some embodiments, the present disclosure provides compositions in which the ELNNs have a low degree of immunogenicity or are substantially non-immunogenic. Several factors can contribute to the low immunogenicity of an ELNN, e.g., the substantially non-repetitive sequence, the unstructured conformation, the high degree of solubility, the low degree or lack of self-aggregation, the low degree or lack of proteolytic sites within the sequence, and the low degree or lack of epitopes in the ELNN.

One of ordinary skill in the art will understand that, in general, polypeptides having highly repetitive short amino acid sequences (e.g., wherein a 200 amino acid-long sequence contain on average 20 repeats or more of a limited set of 3- or 4-mers) and/or having contiguous repetitive amino acid residues (e.g., wherein 5- or 6-mer sequences have identical amino acid residues) have a tendency to aggregate or form higher order structures or form contacts resulting in crystalline or pseudo-crystalline structures.

In some embodiments, a ELNN sequence is substantially non-repetitive, wherein (1) the ELNN sequence has no three contiguous amino acids that are identical amino acid types, unless the amino acid is serine, in which case no more than three contiguous amino acids can be serine residues; and wherein (2) the ELNN contains no 3-amino acid sequences (3-mers) that occur more than 16, more than 14, more than 12, or more than 10 times within an at least 200 amino acid-long sequence of the ELNN (e.g., the entire span of an ELNN that is at least amino acids long). Without being bound by any scientific theory, such substantially non-repetitive sequences have less tendency to aggregate and, thus, enable the design of long-sequence ELNNs with a relatively low frequency of charged amino acids that would be likely to aggregate if the sequences or amino acid residues were otherwise more repetitive.

Conformational epitopes can be formed by regions of protein surfaces that are composed of multiple discontinuous amino acid sequences of a protein antigen. Without being bound by any scientific theory, the precise folding of the protein may bring these sequences into well-defined, stable spatial configurations or epitopes that can be recognized as "foreign" by the host humoral immune system, resulting in the production of antibodies to the protein and/or triggering a cell-mediated immune response. In the latter case, the immune response to a protein in an individual is heavily influenced by T-cell epitope recognition that is a function of the peptide binding specificity of that individual's HLA-DR allotype. Engagement of an MHC Class II peptide complex by a cognate T-cell receptor on the surface of the T-cell, together with the cross-binding of certain other co-receptors such as the CD4 molecule, can induce an activated state within the T-cell. Activation may lead to the release of cytokines further activating other lymphocytes such as B cells to produce antibodies or activating T killer cells as a full cellular immune response.

Without being bound by any scientific theory, the ability of a peptide to bind a given MHC Class II molecule for presentation on the surface of an APC (antigen presenting cell) may depend on a number of factors; most notably its primary sequence. In some embodiments, a lower degree of immunogenicity may be achieved by designing ELNNs that resist antigen processing in antigen presenting cells, and/or choosing sequences that do not bind MHC receptors well. In some embodiments, ELNN-containing fusion proteins have substantially non-repetitive ELNN polypeptides designed to reduce binding with MHC II receptors, as well as to avoid formation of epitopes for T-cell receptor or antibody binding, resulting in a low degree of immunogenicity. Without being bound by any scientific theory, avoidance of immunogenicity is, in part, a direct result of the conformational flexibility of ELNNs; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising ELNNs, using conventional therapeutic practices and dosing, would generally not result in the formation of neutralizing antibodies to the ELNNs, and may also reduce the immunogenicity of BsAb (e.g., TCE) fusion partners in paTCE compositions.

In some embodiments, the ELNNs utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) J Immunol Methods, 281: 95-108). Of particular interest are peptide sequences that can be oligomerized without generating T cell epitopes or non-human sequences. This can be achieved by testing direct repeats of these sequences for the presence of T-cell epitopes and for the occurrence of 6 to 15-mer and, in particular, 9-mer sequences that are not human, and then altering the design of the ELNN sequence to eliminate or disrupt the epitope sequence. In some embodiments, the ELNNs are substantially non-immunogenic by the restriction of the numbers of epitopes of the ELNN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) *Nat Biotechnol*, 17: 555-61), as shown in Example 74 of International Patent Application Publication No. WO 2010/144502 A2, which is incorporated by reference in its entirety. Aspects of the TEPITOPE score of a given peptide frame within a protein are disclosed in Sturniolo, T. et al. (1999) Nature Biotechnology 17:555). The score ranges over at least 20 logs, from about 10 to about −10 (corresponding to binding constraints of $10e^{10}$ $K_D$ to $10e^{-10}$ $K_D$), and can be reduced by avoiding hydrophobic amino acids that can serve as anchor residues during peptide display on MHC, such as M, I, L, V, or F. In some embodiments, an ELNN component incorporated into a paTCE does not have a predicted T-cell epitope at a TEPITOPE score of about −5 or greater, or − 6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In some embodiments, the ELNNs, including those incorporated into the subject paTCE fusion proteins, can be rendered substantially non-immunogenic by the restriction of known proteolytic sites from the sequence of the ELNN, reducing the processing of ELNN into small peptides that can bind to MHC II receptors. In some embodiments, the ELNN sequence can be rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the ELNN may render the ELNN compositions, including the ELNN of the paTCE fusion protein compositions, substantially unable to be bound by mammalian receptors, including those of the immune system. In some embodiments, an ELNN of a paTCE fusion protein can have >100 nM $K_D$ binding to a mammalian receptor, or greater than 500 nM $K_D$, or greater than 1 µM $K_D$ towards a mammalian cell surface or circulating polypeptide receptor.

Additionally, the substantially non-repetitive sequence and corresponding lack of epitopes of such embodiments of ELNNs can limit the ability of B cells to bind to or be activated by the ELNNs. In some embodiments, while an ELNN can make contacts with many different B cells over its extended sequence, each individual B cell may only make one or a small number of contacts with an individual ELNN. As a result, ELNNs typically may have a much lower tendency to stimulate proliferation of B cells and thus an immune response. In some embodiments, the paTCE may have reduced immunogenicity as compared to the corresponding BsAb (e.g., TCE) that is not fused to a mask polypeptide such as an ELNN. In some embodiments, the administration of up to three parenteral doses of a paTCE to a mammal may result in detectable anti-paTCE IgG at a serum dilution of 1:100 but not at a dilution of 1:1000. In some embodiments, the administration of up to three parenteral doses of an paTCE to a mammal may result in detectable anti-BsAb (e.g., TCE) IgG at a serum dilution of 1:100 but not at a dilution of 1:1000. In some embodiments, the administration of up to three parenteral doses of an paTCE to a mammal may result in detectable anti-ELNN IgG at a serum dilution of 1:100 but not at a dilution of 1:1000. In some embodiments, the mammal can be, e.g., a mouse, a rat, a rabbit, cynomolgus monkey, or human. In some embodiments, the mammal is a human.

An additional feature of certain ELNNs with substantially non-repetitive sequences relative to those less non-repetitive sequences (such as one having three contiguous amino acids that are identical) can be that non-repetitive ELNNs form weaker contacts with antibodies (e.g., monovalent interactions), thereby resulting in less likelihood of immune clearance such that the paTCE compositions can remain in circulation for an increased period of time.

In some embodiments, a biologically active polypeptide (such as a BsAb, e.g., a TCE) comprising an ELNN is less immunogenic compared to the fusion polypeptide not linked to any ELNN, wherein immunogenicity is ascertained by measuring production of IgG antibodies that selectively bind to the biologically active polypeptide after administration of comparable doses to a subject.

Barcode Fragment

In some embodiments, a polypeptide (e.g., a fusion polypeptide or a portion thereof such as an ELNN) comprises one or more barcode fragments (e.g., a first, second, or third barcode fragment) releasable from the polypeptide upon digestion by a protease. In some embodiments, the protease is a non-mammalian protease. In some embodiments, the protease is a prokaryotic protease. As used herein, the term "barcode fragment" (or "barcode," or "barcode sequence") can refer to either the portion of the polypeptide cleavably fused within the polypeptide, or the resulting peptide fragment released from the polypeptide.

In some embodiments, a barcode fragment (1) is a portion of an ELNN that includes at least part of the (non-recurring, non-overlapping) sequence motif that occurs (or is found) only once within the ELNN; and (2) differs in sequence and molecular weight from all other peptide fragments that are releasable from the polypeptide upon cleavage or complete digestion of the polypeptide by the protease.

In some embodiments, a barcode fragment does not include the N-terminal amino acid or the C-terminal amino acid of the fusion polypeptide. As described herein, in some embodiments, a barcode fragment is releasable (e.g., configured to be released) upon Glu-C digestion of the fusion polypeptide. In some embodiments, a barcode fragment is in an ELNN and does not include a glutamic acid that is immediately adjacent to another glutamic acid, if present, in the ELNN. In some embodiments, a barcode fragment has a glutamic acid at its C-terminus. One of ordinary skill in the art will understand that the C-terminus of a barcode fragment can refer to the "last" (or the most C-terminal) amino acid residue within the barcode fragment, when cleavably fused within a polypeptide (such as an ELNN), even if other non-barcode amino acid residues are positioned C-terminal to the barcode fragment within the polypeptide (e.g., ELNN). In some embodiments, a barcode fragment has an N-terminal amino acid that is immediately preceded by a glutamic acid residue. In some embodiments, the glutamic acid residue that precedes the N-terminal amino acid is not immediately adjacent to another glutamic acid residue. In some embodiments, a barcode fragment does not include a (second) glutamic acid residue at a position other than the C-terminus of the barcode fragment unless the glutamic acid is immediately followed by a proline. In some embodiments, a barcode fragment is positioned a distance from either the N-terminus of the polypeptide or the C-terminus of the polypeptide, wherein the distance is from 10 to 150, or 10 to 125 amino acids. In some embodiments, a barcode fragment is positioned within, or at a location of, 300, 280, 260, 250, 240, 220, 200, 190, 180, 170, 160, 150, 140,130, 120, 110, 100, 90, 80, 70, 60, 50, 48, 40, 36, 30, 24, 20, 12, or 10 amino acids from the N-terminus of the polypeptide, or at a location in a range between any of the foregoing. In some embodiments, a barcode fragment is positioned within 200, within 150, within 100, or within 50 amino acids of the N-terminus of the polypeptide. In some embodiments, a barcode fragment is positioned at a location that is between 10 and 200, between 30 and 200, between 40 and 150, or between 50 and 100 amino acids from the N-terminus of the polypeptide. In some embodiments, a barcode fragment is positioned within, or at a location of, 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the C-terminus of the polypeptide, or at a location in a range between any of the foregoing. In some embodiments, a barcode fragment is positioned within 200, within 150, within 100, or within 50 amino acids of the C-terminus of the polypeptide. In some embodiments, a barcode fragment is positioned at a location that is between 10 and 200, between 30 and 200, between 40 and 150, or between 50 and 100 amino acids from the C-terminus of the polypeptide. In some embodiments, a barcode fragment (BAR) is characterized in that: (i) it does not include a glutamic acid that is immediately adjacent to another glutamic acid, if present, in the ELNN; (ii) it has a glutamic acid at its C-terminus; (iii) it has an N-terminal amino acid that is immediately preceded by a glutamic acid residue; and (iv) it is positioned a distance from either the N-terminus of the polypeptide or the C-terminus of the polypeptide, wherein the distance is from 10 to 150 amino acids, or from 10 to 125 amino acids in length. In some embodiments, a barcode fragment is in an ELNN and (i) does not include the N-terminal amino acid or the C-terminal amino acid of the polypeptide; (ii) does not include a glutamic acid that is immediately adjacent to another glutamic acid in the ELNN; (iii) has a glutamic acid at its C-terminus; (iv) has an N-terminal amino acid that is immediately preceded by a glutamic acid residue; and (v) is positioned a distance from either the N-terminus of the polypeptide or the C-terminus of the polypeptide, wherein the distance is from 10 to 150, or 10 to 125 amino acids in length. In some embodiments, the glutamic acid residue that precedes the N-terminal amino acid is not immediately adjacent to another glutamic acid residue. In some embodiments, a barcode fragment does not include a glutamic acid residue at a position other than the C-terminus of the barcode fragment unless the glutamic acid is immediately followed by a proline. Depending on context herein and when referring to placement within a polypeptide sequence, the term "distance" can refer to the number of amino acid residues from the N-terminus of the polypeptide to the most N-terminal amino acid residue of the barcode fragment, or from the C-terminus of the polypeptide to the most C-terminal amino acid residue of the barcode fragment. In some embodiments, for a barcoded ELNN fused to a biologically active polypeptide, at least one barcode fragment (or at least two barcode fragments, or three barcode fragments) contained in the barcoded ELNN is positioned at least 50, 75, 100, 125, 150, 175, 200, 225, 250, 275, 300 amino acids from the biologically active polypeptide. In some embodiments, a barcode fragment is at least 4, at least 5, at least 6, at least 7, or at least 8 amino acids in length. In some embodiments, a barcode fragment is at least 4 amino acids in length. In some embodiments, a barcode fragment is 4, 5, 6, 7, 8, 9, 10, 11, 12, 13, 14, 15, 16, 17, 18, 19, 20, 21, 22, 23, 24, 25 amino acids in length, or in a range between any of the foregoing values. In some embodiments, a barcode fragment is between 4 and 20, between 5 and 15, between 6 and 12, or between 7 and 10 amino acids in length. In some embodiments, a barcode fragment comprises an amino acid sequence identified herein by SEQ ID NOs: 68-79 and SEQ ID NOs: 1010-1027 in Table 2.

TABLE 2

Exemplary Barcode Fragments Releasable Upon Glu-C Digest

| Amino Acid Sequence | SEQ ID NO: |
|---|---|
| SPATSGSTPE | 68 |
| GSAPATSE | 69 |
| GSAPGTATE | 70 |
| GSAPGTE | 71 |
| PATSGPTE | 72 |
| SASPE | 73 |
| PATSGSTE | 74 |
| GSAPGTSAE | 75 |
| SATSGSE | 76 |
| SGPGSTPAE | 77 |
| SGPGSGPGTSE | 78 |
| SGPGTSPSATPE | 79 |
| SGPGTGTSATPE | 1010 |
| SGPGTTPGTTPE | 1011 |
| SGPGTPPTSTPE | 1012 |
| SGPGTGSAGTPE | 1013 |
| SGPGTGGAGTPE | 1014 |
| SGPGTSPGATPE | 1015 |
| SGPGTSGSGTPE | 1016 |
| SGPGTSSASTPE | 1017 |
| SGPGTGAGTTPE | 1018 |
| SGPGTGSTSTPE | 1019 |
| TPGSEPATSGSE | 1020 |
| GSAPGTSTEPSE | 1021 |
| SGPGTAGSGTPE | 1022 |
| SGPGTSSGGTPE | 1023 |
| SGPGTAGPATPE | 1024 |
| SGPGTPGTGTPE | 1025 |
| SGPGTGGPTTPE | 1026 |
| SGPGTGSGSTPE | 1027 |

In some embodiments, each barcode fragment differs in both sequence and molecular weight from all other peptide fragments that are releasable from the chimeric polypeptides described herein upon complete digestion the chimeric polypeptide by a non-mammalian protease. In some embodiments, the non-mammalian protease is Glu-C.

In some embodiments, the chimeric polypeptides disclosed herein comprises a Glu-C cleavage site comprising one of the following amino acid sequences: ATPESGPG (SEQ ID NO:9020), SGSETPGT (SEQ ID NO:9021), and GTSESATP (SEQ ID NO:9022).

In some embodiments, the chimeric polypeptides disclosed herein comprises at least one of the following amino acid sequences: PE.GSX$_n$PE.SG (SEQ ID NO:9392), PE.GSX$_n$SE.GG (SEQ ID NO:9393), PE.GSX$_n$SE.TG (SEQ ID NO:9395), PE.GSX$_n$SE.SA (SEQ ID NO:9396), PE.SGX$_n$PE.SG (SEQ ID NO:9397), PE.SGX$_n$SE.GG (SEQ ID NO:9399), PE.SGX$_n$SE.TG (SEQ ID NO:9400), PE.SGX$_n$SE.SA (SEQ ID NO:9401), and PE.TPX$_n$PE.SG (SEQ ID NO:9403), PE.TPX$_n$SE.GG (SEQ ID NO:9404), PE.TPX$_n$SE.TG (SEQ ID NO:9405), PE.TPX$_n$SE.SA (SEQ ID NO:9407), wherein each "." is a Glu-C cleavage site and n is any integer from 0 to 50. In some embodiments, the chimeric polypeptides disclosed herein comprises at least one of the following amino acid sequences: PE.SGX$_n$PE.SG (SEQ ID NO:9398), PE.GSX$_n$SE.GG (SEQ ID NO:9394), PE.TPX$_n$SE.TG (SEQ ID NO:9406), PE.SGX$_n$SE.SA (SEQ ID NO:9402). In some embodiments, n is any integer from 1 to 20. In some embodiments, n is any integer from 5 to 15. In some embodiments, n is any integer from 5 to 10. In some embodiments, n is 9. In some embodiments, n is any integer from 5 to 15. In some embodiments, X$_n$ is SGPGTGTSATPE (SEQ ID NO:1010), SGPGSGPGTSE (SEQ ID NO:78), SGPGTTPGTTPE (SEQ ID NO:1011), SGPGTPPTSTPE (SEQ ID NO:1012), SGPGTSPSATPE (SEQ ID NO:79), SGPGTGSAGTPE (SEQ ID NO:1013), SGPGTGGAGTPE (SEQ ID NO:1014), SGPGTSPGATPE (SEQ ID NO:1015), SGPGTSGSGTPE (SEQ ID NO:1016), SGPGTSSASTPE (SEQ ID NO:1017), SGPGTGAGTTPE (SEQ ID NO:1018), SGPGTGSTSTPE (SEQ ID NO:1019), TPGSEPATSGSE (SEQ ID NO:1020), GSAPGTSTEPSE (SEQ ID NO:1021), SGPGTAGSGTPE (SEQ ID NO:1022), SGPGTSSGGTPE (SEQ ID NO:1023), SGPGTAGPATPE (SEQ ID NO:1024), SGPGTPGTGTPE (SEQ ID NO:1025), SGPGTGGPTTPE (SEQ ID NO:1026), or SGPGTGSGSTPE (SEQ ID NO:1027).

In some embodiments, a chimeric polypeptide comprises at least one of the following amino acid sequences: SGPE.SGPGX$_n$SGPE.SGPG (SEQ ID NO:9023), SGPE.SGPGX$_n$ATPE.SGPG (SEQ ID NO:9024), SGPE.SGPGX$_n$GTSE.SATP (SEQ ID NO:9025), SGPE.SGPGX$_n$TTPE.SGPG (SEQ ID NO:9026), SGPE.SGPGX$_n$STPE.SGPG (SEQ ID NO:9027), SGPE.SGPGX$_n$GTPE.SGPG (SEQ ID NO:9028), SGPE.SGPGX$_n$GTPE.TPGS (SEQ ID NO:9029), SGPE.SGPGX$_n$GTPE.TPGS (SEQ ID NO:9029), SGPE.SGPGX$_n$SGSE.TGTP (SEQ ID NO:9030), SGPE.SGPGX$_n$GTPE.GSAP (SEQ ID NO:9031), SGPE.SGPGX$_n$EPSE.SATP (SEQ ID NO:9032), ATPE.SGPGX$_n$SGPE.SGPG (SEQ ID NO:9033), ATPE.SGPGX$_n$ATPE.SGPG (SEQ ID NO:9034), ATPE.SGPGX$_n$GTSE.SATP (SEQ ID NO:9035), ATPE.SGPGX$_n$TTPE.SGPG (SEQ ID NO:9036), ATPE.SGPGX$_n$STPE.SGPG (SEQ ID NO:9037), ATPE.SGPGX$_n$GTPE.SGPG (SEQ ID NO:9043), ATPE.SGPGX$_n$GTPE.TPGS (SEQ ID NO:9045), ATPE.SGPGX$_n$SGSE.TGTP (SEQ ID NO:9046), ATPE.SGPGX$_n$GTPE.GSAP (SEQ ID NO:9047), ATPE.SGPGX$_n$EPSE.SATP (SEQ ID NO:9048), GTSE.SATPX$_n$SGPE.SGPG (SEQ ID NO:9049), GTSE.SATPX$_n$ATPE.SGPG (SEQ ID NO:9050), GTSE.SATPX$_n$GTSE.SATP (SEQ ID NO:9051), GTSE.SATPX$_n$TTPE.SGPG (SEQ ID NO:9052), GTSE.SATPX$_n$STPE.SGPG (SEQ ID NO:9053), GTSE.SATPX$_n$GTPE.SGPG (SEQ ID NO:9054), GTSE.SATPX$_n$GTPE.TPGS (SEQ ID NO:9055), GTSE.SATPX$_n$SGSE.TGTP (SEQ ID NO:9056), GTSE.SATPX$_n$GTPE.GSAP (SEQ ID NO:9057), GTSE.SATPX$_n$EPSE.SATP (SEQ ID NO:9058), TTPE.SGPGX$_n$SGPE.SGPG (SEQ ID NO:9059), TTPE.SGPGX$_n$ATPE.SGPG (SEQ ID NO:9060), TTPE.SGPGX$_n$GTSE.SATP (SEQ ID NO:9061), TTPE.SGPGX$_n$TTPE.SGPG (SEQ ID NO:9062), TTPE.SGPGX$_n$STPE.SGPG (SEQ ID NO:9064), TTPE.SGPGX$_n$GTPE.SGPG (SEQ ID NO:9065), TTPE.SGPGX$_n$GTPE.TPGS (SEQ ID NO:9066), TTPE.SGPGX$_n$SGSE.TGTP (SEQ ID NO:9067), TTPE.SGPGX$_n$GTPE.GSAP (SEQ ID NO:9068), TTPE.SGPGX$_n$EPSE.SATP (SEQ ID NO:9069), STPE.SGPGX$_n$SGPE.SGPG (SEQ ID NO:9070), STPE.SGPGX$_n$ATPE.SGPG (SEQ ID NO:9071), STPE.SGPGX$_n$GTSE.SATP (SEQ ID NO:9072), STPE.SGPGX$_n$TTPE.SGPG (SEQ ID NO:9073), STPE.SGPGX$_n$STPE.SGPG (SEQ ID NO:9074), STPE.SGPGX$_n$GTPE.SGPG (SEQ ID NO:9076), STPE.SGPGX$_n$GTPE.TPGS (SEQ ID NO:9077), STPE.SGPGX$_n$SGSE.TGTP (SEQ ID NO:9078), STPE.SGPGX$_n$GTPE.GSAP (SEQ ID NO:9079), STPE.SGPGX$_n$EPSE.SATP (SEQ ID NO:9080), GTPE.SGPGX$_n$SGPE.SGPG (SEQ ID NO:9081), GTPE.SGPGX$_n$ATPE.SGPG (SEQ ID NO:9082), GTPE.SGPGX$_n$GTSE.SATP (SEQ ID NO:9083), GTPE.SGPGX$_n$TTPE.SGPG (SEQ ID NO:9084), GTPE.SGPGX$_n$STPE.SGPG (SEQ ID NO:9086), GTPE.SGPGX$_n$GTPE.SGPG (SEQ ID NO:9088), GTPE.SGPGX$_n$GTPE.TPGS (SEQ ID NO:9090), GTPE.SGPGX$_n$SGSE.TGTP (SEQ ID NO:9091), GTPE.SGPGX$_n$GTPE.GSAP (SEQ ID NO:9092), GTPE.SGPGX$_n$EPSE.SATP (SEQ ID NO:9093), GTPE.TPGSX$_n$SGPE.SGPG (SEQ ID NO:9094), GTPE.TPGSX$_n$ATPE.SGPG (SEQ ID NO:9095), GTPE.TPGSX$_n$GTSE.SATP (SEQ ID NO:9096), GTPE.TPGSX$_n$TTPE.SGPG (SEQ ID NO:9097), GTPE.TPGSX$_n$STPE.SGPG (SEQ ID NO:9098), GTPE.TPGSX$_n$GTPE.SGPG (SEQ ID NO:9099), GTPE.TPGSX$_n$GTPE.TPGS (SEQ ID NO:9100), GTPE.TPGSX$_n$SGSE.TGTP (SEQ ID NO:9101), GTPE.TPGSX$_n$GTPE.GSAP (SEQ ID NO:9103), GTPE.TPGSX$_n$EPSE.SATP (SEQ ID NO:9104), SGSE.TGTPX$_n$SGPE.SGPG (SEQ ID NO:9105), SGSE.TGTPX$_n$ATPE.SGPG (SEQ ID NO:9106), SGSE.TGTPX$_n$GTSE.SATP (SEQ ID NO:9107), SGSE.TGTPX$_n$TTPE.SGPG (SEQ ID NO:9108), SGSE.TGTPX$_n$STPE.SGPG (SEQ ID NO:9109), SGSE.TGTPX$_n$GTPE.SGPG (SEQ ID NO:9110), SGSE.TGTPX$_n$GTPE.TPGS (SEQ ID NO:9111), SGSE.TGTPX$_n$SGSE.TGTP (SEQ ID NO:9112), SGSE.TGTPX$_n$GTPE.GSAP (SEQ ID NO:9113), SGSE.TGTPX$_n$EPSE.SATP (SEQ ID NO:9114), GTPE.GSAPX$_n$SGPE.SGPG (SEQ ID NO:9115), GTPE.GSAPX$_n$ATPE.SGPG (SEQ ID NO:9116), GTPE.GSAPX$_n$GTSE.SATP (SEQ ID NO:9117), GTPE.GSAPX$_n$TTPE.SGPG (SEQ ID NO:9118), GTPE.GSAPX$_n$STPE.SGPG (SEQ ID NO:9119), GTPE.GSAPX$_n$GTPE.SGPG (SEQ ID NO:9120), GTPE.GSAPX$_n$GTPE.TPGS (SEQ ID NO:9121), GTPE.GSAPX$_n$SGSE.TGTP (SEQ ID NO:9122), GTPE.GSAPX$_n$GTPE.GSAP (SEQ ID NO:9123), GTPE.GSAPX$_n$EPSE.SATP (SEQ ID NO:9124), EPSE.SATPX$_n$SGPE.SGPG (SEQ ID NO:9126), EPSE.SATPX$_n$ATPE.SGPG (SEQ ID NO:9127), EPSE.SATPX$_n$GTSE.SATP (SEQ ID NO:9128), EPSE.SATPX$_n$TTPE.SGPG (SEQ ID NO:9129), EPSE.SATPX$_n$STPE.SGPG (SEQ ID NO:9130), EPSE.SATPX$_n$GTPE.SGPG (SEQ ID NO:9131), EPSE.SATPX$_n$GTPE.TPGS (SEQ ID NO:9132), EPSE.SATPX$_n$SGSE.TGTP (SEQ ID NO:9133), EPSE.SATPX$_n$GTPE.GSAP (SEQ ID NO:9134), or EPSE.SATPX$_n$EPSE.SATP (SEQ ID NO:9135), wherein each "." is a Glu-C cleavage site and n is any integer from 0 to 50. In some embodiments, the chimeric polypeptide comprises at least one of the following amino acid sequences: SGPE.SGPGX$_n$ATPE.SGPG (SEQ ID NO:9038), ATPE.SGPGX$_n$GTSE.SATP (SEQ ID NO:9040), ATPE.SGPGX$_n$TTPE.SGPG (SEQ ID NO:9041), ATPE.SGPGX$_n$STPE.SGPG (SEQ ID NO:9042), ATPE.SGPGX$_n$ATPE.SGPG (SEQ ID NO:9039), ATPE.SGPGX$_n$GTPE.SGPG (SEQ ID NO:9044), ATPE.SGPGX$_n$GTPE.SGPG (SEQ ID NO:9044), ATPE.SGPGX$_n$ATPE.SGPG (SEQ ID NO:9039), GTPE.SGPGX$_n$GTPE.SGPG (SEQ ID NO:9089), GTPE.SGPGX$_n$STPE.SGPG (SEQ ID NO:9087), GTPE.SGPGX$_n$TTPE.SGPG (SEQ ID NO:9085), GTPE.SGPGX$_n$STPE.SGPG (SEQ ID NO:9087), GTPE.TPGSX$_n$SGSE.TGTP (SEQ ID NO:9102), GTPE.GSAPX$_n$EPSE.SATP (SEQ ID NO:9125), ATPE.SGPGX$_n$GTPE.SGPG (SEQ ID NO:9044), ATPE.SGPGX$_n$GTPE.SGPG (SEQ ID NO:9044), ATPE.SGPGX$_n$ATPE.SGPG (SEQ ID NO:9039), ATPE.SGPGX$_n$GTPE.SGPG (SEQ ID NO:9044), TTPE.SGPGX$_n$TTPE.SGPG (SEQ ID NO:9063), or STPE.SGPGX$_n$STPE.SGPG (SEQ ID NO:9075), wherein each "." is a Glu-C cleavage site and n is any integer from 0 to 30. In some embodiments, n is any integer from 1 to 20. In some embodiments, n is any integer from 5 to 15. In some embodiments, n is any integer from 3 to 7. In some embodiments, n is any integer from 5 to 10. In some embodiments, n is 9. In some embodiments, n is 4. In some embodiments, n is any integer from 5 to 15. In some embodiments, wherein X$_n$ is PGTGTSAT (SEQ ID NO:9136), PGSGPGT (SEQ ID NO:9137), PGTTPGTT (SEQ ID NO:9138), PGTPPTST (SEQ ID NO:9139), PGTSPSAT (SEQ ID NO:9140), PGTGSAGT (SEQ ID NO:9141), PGTGGAGT (SEQ ID NO:9142), PGTSPGAT (SEQ ID NO:9143), PGTSGSGT (SEQ ID NO:9144), PGTSSAST (SEQ ID NO:9145), PGTGAGTT (SEQ ID NO:9146), PGTGSTST (SEQ ID NO:9147), GSEPATSG (SEQ ID NO:9148), APGTSTEP (SEQ ID NO:9149), PGTAGSGT (SEQ ID NO:9150), PGTSSGGT (SEQ ID NO:9151), PGTAGPAT (SEQ ID NO:9152), PGTPGTGT (SEQ ID NO:9153), PGTGGPTT (SEQ ID NO:9154), or PGTGSGST (SEQ ID NO:9155). In some embodiments, X$_n$ is TGTS (SEQ ID NO:9156), SGP, TTPG (SEQ ID NO:9157), TPPT (SEQ ID NO:9158), TSPS (SEQ ID NO:9159), TGSA (SEQ ID NO:9160), TGGA (SEQ ID NO:9161), TSPG (SEQ ID NO:9162), TSGS (SEQ ID NO:9163), TSSA (SEQ ID NO:9164), TGAG (SEQ ID NO:9165), TGST (SEQ ID NO:9166), EPAT (SEQ ID NO:9167), GTST (SEQ ID NO:9168), TAGS (SEQ ID NO:9169), TSSG (SEQ ID NO:9170), TAGP (SEQ ID NO:9171), TPGT (SEQ ID NO:9172), TGGP (SEQ ID NO:9173), or TGSG (SEQ ID NO:9174).

In some embodiments, barcodes are designed to have improved analytical properties. In some embodiments, such barcodes can be released with relatively modest concentrations of a non-mammalian protease such as Glu-C. This facilitates better detection, e.g., through LC/MS, and also allows measurement of peptides that are generated from the cleavable linker thereby allowing a measurement of cleavage products using, e.g., LC/MS.

In some embodiments of fusion proteins comprising an ELNN, the fusion protein has a single polypeptide chain, and the polypeptide chain comprises a barcode fragment that is at a position within the polypeptide chain that is from 10 to 200 amino acids or from 10 to 125 amino acids from the N-terminus or the C-terminus of the polypeptide chain. In some embodiments, a fusion protein (such as a paTCE) comprises a first ELNN and a second ELNN, the first ELNN is at the N-terminal side of the bispecific antibody domain, and the first barcode fragment is positioned within 200, 150, 100, or 50 amino acids of the N-terminus of the fusion protein. In some embodiments, the second ELNN is at the C-terminal side of the bispecific antibody domain, and the second barcode fragment is positioned within 200, 150, 100, or 50 amino acids of the C-terminus of the chimeric polypeptide.

In some embodiments, an ELNN further comprises one or more additional barcode fragments, wherein the one or more additional barcode fragments each differs in sequence and molecular weight from all other peptides fragments that are releasable from the polypeptide upon complete digestion of the polypeptide by the protease. In some embodiments, a barcoded ELNN comprises only one barcode fragment. In some embodiments, a barcoded ELNN comprises a set of barcode fragments, comprising a first barcode fragment, such as those described herein. In some embodiments, the set of barcode fragments comprises a second barcode fragment (or a further barcode fragment), such as those described herein. In some embodiments, the set of barcode fragments comprises a third barcode fragment, such as those described herein.

A set of barcode fragments fused within an N-terminal ELNN can be referred to as an N-terminal set of barcodes (an "N-terminal set"). A set of barcode fragments fused within a C-terminal ELNN can be referred to as a C-terminal set of barcodes (a "C-terminal set"). In some embodiments, the N-terminal set comprises a first barcode fragment and a second barcode fragment. In some embodiments, the N-terminal set further comprises a third barcode fragment. In some embodiments, the C-terminal set comprises a first barcode fragment and a second barcode fragment. In some embodiments, the C-terminal set further comprises a third barcode fragment. In some embodiments, the polypeptide comprises a set of barcode fragments that includes a first barcode fragment, a further (second) barcode fragment, and at least one additional barcode fragment, wherein each barcode fragment of the set of barcode fragments (1) is a portion of the second ELNN and (2) differs in sequence and molecular weight from all other peptides fragments that are releasable from the polypeptide upon complete digestion of the polypeptide by the protease.

Included herein is a mixture comprising a plurality of polypeptides of varying length; the mixture comprising a first set of polypeptides and a second set of polypeptides. In some embodiments, each polypeptide of the first set of polypeptides comprises a barcode fragment that (a) is releasable from the polypeptide by digestion with a protease and (b) has a sequence and molecular weight that differs from the sequence and molecular weight of all other fragments that are releasable from the first set of polypeptides. In some embodiments, the second set of polypeptides lack the barcode fragment of the first set of polypeptides (e.g., due to truncation). In some embodiments, both the first set of polypeptides and the second set of polypeptides each comprise a reference fragment that (a) is common to the first set of polypeptides and the second set of polypeptides and (b) releasable by digestion with the protease. In some embodiments, the ratio of the first set of polypeptides to polypeptides comprising the reference fragment is greater than 0.70. In some embodiments, the ratio of the first set of polypeptides to polypeptides comprising the reference fragment is greater than 0.80, 0.90, 0.95, or 0.98. In some embodiments, the reference fragment occurs no more than once in each polypeptide of the first set of polypeptides and the second set of polypeptides. In some embodiments, the protease is a protease that cleaves on the C-terminal side of glutamic acid residues. In some embodiments, the protease is a Glu-C protease. In some embodiments, the protease is not trypsin. In some embodiments, the polypeptides of varying lengths comprise polypeptides comprising at least one ELNN, such as any described herein. In some embodiments, the first set of polypeptides comprises a full-length polypeptide, wherein the barcode fragment is a portion of the full-length polypeptide. In some embodiments, the full-length polypeptide is a (fusion) polypeptide, such as any described hereinabove or described anywhere else herein. In some embodiments, the polypeptides of varying lengths in a mixture differ from one another due to N-terminal truncation, C-terminal truncation, or both N- and C-terminal truncation of a full-length polypeptide. In some embodiments, the first set of polypeptides and the second set of polypeptides may differ in one or more pharmacological properties.

The present disclosure also provides methods for assessing, in a mixture comprising polypeptides of varying length, a relative amount of a first set of polypeptides in the mixture to a second set of polypeptides in the mixture, wherein (1) each polypeptide of the first set of polypeptides shares a barcode fragment that occurs once and only once in the polypeptide and (2) each polypeptide of the second set of polypeptides lacks the barcode fragment that is shared by polypeptides of the first set, wherein individual polypeptides of both the first of polypeptides and the second set of polypeptides each comprises a reference fragment. In some embodiments, the methods comprise contacting the mixture with a protease to produce a plurality of proteolytic fragments that result from cleavage of the first set of polypeptides and the second set of polypeptides, wherein the plurality of proteolytic fragments comprise a plurality of reference fragments, and a plurality of barcode fragments. In some embodiments, the methods can further comprise determining a ratio of the amount of barcode fragments to the amount of reference fragments, thereby assessing the relative amounts of the first set of polypeptides to the second set of polypeptides. In some embodiments, the barcode fragment occurs no more than once in each polypeptide of the first set of polypeptides. In some embodiments, the reference fragment occurs no more than once in each polypeptide of the first set of polypeptides and the second set of polypeptides. In some embodiments, the plurality of proteolytic fragments comprises a plurality of reference fragments, and a plurality of barcode fragments. In some embodiments, the protease cleaves the first and second sets of polypeptides (or the polypeptides of varying length) on the C-terminal side of glutamic acid residues that are not followed by a proline residue. In some embodiments, the protease is a Glu-C protease. In some embodiments, the protease is not trypsin. In some embodiments, the step of determining a ratio of the amount of barcode fragments to the amount of reference fragments comprises identifying barcode fragments and reference fragments from the mixture after it has been contacted with the protease. In some embodiments, the barcode fragments and the reference fragments are identified based on their respective masses. In some embodiments, the barcode fragments and the reference fragments are identified via mass spectrometry.

In some embodiments, the barcode fragments and reference fragments are identified via liquid chromatography-mass spectrometry (LC-MS). In some embodiments, the step of determining a ratio of the barcode fragments to the reference fragments comprises isobaric labeling. In some embodiments, the step of determining a ratio of the barcode fragments to the reference fragments comprises spiking the mixture with one or both of an isotope-labeled reference fragment and an isotope labeled barcode fragment. In some embodiments, the polypeptides of varying lengths comprise polypeptides that comprise at least one ELNN, as described hereinabove or described anywhere else herein. In some embodiments, the ELNN is characterized in that (i) it comprises at least 100, or at least 150 amino acids; (ii) at least 90% of the amino acid residues of the ELNN are glycine (G), alanine (A), serine (S), threonine (T), glutamate (E) or proline (P); and (iii) it comprises at least 4 different types of amino acids that are G, A, S, T, E, or P. In some embodiments, the barcode fragment, when present, is a portion of the ELNN. In some embodiments, the mixture of polypeptides of varying lengths comprises a polypeptide as any described hereinabove or described anywhere else herein. In some embodiments, the polypeptides of varying length comprise a full-length polypeptide and truncated fragments thereof. In some embodiments, the polypeptides of varying length consist essentially of the full-length polypeptide and truncated fragments thereof. In some embodiments, the polypeptides of varying lengths in a mixture differ from one another due to N-terminal truncation, C-terminal truncation, or both N- and C-terminal truncation of a full-length polypeptide. In some embodiments, the full-length polypeptide is a polypeptide as described hereinabove or described anywhere else herein. In some embodiments, the ratio of the amount of barcode fragments to reference fragments is greater than 0.50, 0.60, 0.70, 0.80, 0.90, 0.95, 0.98, or 0.99.

Isobaric Labeling-Based Quantification of Peptides

In some embodiments, isobaric labeling can be used for determining a ratio of the barcode fragments to the reference fragments. Isobaric labeling is a mass spectrometry strategy used in quantitative proteomics, wherein peptides or proteins (or portions thereof) are labeled with various chemical groups that are isobaric (identical in mass) but vary in terms of distribution of heavy isotopes around their structure. In some embodiments, these tags, commonly referred to as tandem mass tags, are designed so that the mass tag is cleaved at a specific linker region upon high-energy collision-induced dissociation (CID) during tandem mass spectrometry, thereby yielding reporter ions of different masses. Some of the most common isobaric tags are amine-reactive tags.

Exemplary Barcoded ELNN Polypeptides

Included herein are ELNNs comprising barcode fragments that are portions of the ELNNs.

Amino acid sequences of exemplary barcoded ELNNs, containing one barcode (e.g., SEQ ID NOs: 8002-8003, 8005-8009, and 8013-8022), or two barcodes (e.g., SEQ ID NOS: 8001, 8004, and 8012), or three barcodes (e.g., SEQ ID NO: 8011), are illustrated in Table 3a, with barcodes being identified in bold. In some embodiments, among these exemplary barcoded ELNNs, 12 (SEQ ID NOs: 8001-8003, 8008-8009, 8011, 8015-8019, and 8022) are to be fused to a biologically-active protein (such as a TCE) at the C-terminal of the biologically-active protein, and 10 (SEQ ID NOS: 8004-8007, 8010, 8012-8014, 8020, and 8021) are to be fused at the N-terminal of the biologically-active protein. In some embodiments, the ELNN has at least 90%, at least 92%, at least 95%, at least 98%, at least 99% or 100% sequence identity to a sequence identified herein by SEQ ID NOs: 8001-8022 in Table 3a.

TABLE 3a

Exemplary Barcoded ELNNs

| SEQ ID NO. | ELNN Type | # of Barcode(s) | Amino Acid Sequence | Total # of AAs |
|---|---|---|---|---|
| 8001 | C-terminal ELNN | 2 | PGSPAGSPTSTEEGTSESATPESGPGTSTEPSE GSAPGSPAGSPTSTEEGTSTEPSEGSAPGTSTE PSEGSAPGTSESATPESGPGSEPATSGSETPG SEPATSGSETPGSPAGSPTSTEEGTSESATPES GPGTSTEPSEGSAPGTSTEPSEGSAPGSPAGS PTSTEEGTSTEPSEGSAPGTSTEPSEGSAPGTS ESATPESGPGTSTEPSEGSAPGTSESATPESGP GSEPATSGSETPGTSTEPSEGSAPGTSTEPSEG SAPGTSESATPESGPGTSESATPESGPGSPAG SPTSTEEGTSESATPESGPGSEPATSGSETPGT SESATPESGPGTSTEPSEGSAPGTSTEPSEGSA PGTSTEPSEGSAPGTSTEPSEGSAPGTSTEPSE GSAPGTSTEPSEGSAPGSPAGSPTSTEEGTSTE PSEGSAPGTSESATPESGPGSEPATSGSETPG TSESATPESGPGSEPATSGSETPGTSESATPES GPGTSTEPSEGSAPGTSESATPESGPGSPAGS PTSTEEGSPAGSPTSTEEGSPAGSPTSTEEGTS ESATPESGPGTSTEPSEGSAPGTSESATPESGP GSEPATSGSETPGTSESATPESGPGSEPATSG SETPGTSESATPESGPGTSTEPSEGSAPGSPA GSPTSTEEGTSESATPESGPGSEPATSGSETPG TSESATPESGPGSPAGSPTSTEEGSPAGSPTST EEGTSTEPSEGSAPGTSESATPESGPGTSESAT PESGPGftabTSESATPESGPGSEPATSGPTESG SEPATSGSETPGSPAGSPTSTEEGTSTEPSE<u>GS</u> <u>APGTE</u>STPSEGSAPGSEPATSGSETPGTSESAT PESGPGTSTEPSEGSAPGEPEA | 864 |
| 8002 | C-terminal ELNN | 1 | PGSPAGSPTSTEEGTSESATPESGPGTSTEPSE GSAPGSPAGSPTSTEEGTSTEPSEGSAPGTSTE PSEGSAPGTSESATPESGPGSEPATSGSETPG SEPATSGSETPGSPAGSPTSTEEGTSESATPES GPGTSTEPSEGSAPGTSTEPSEGSAPGSPAGS PTSTEEGTSTEPSEGSAPGTSTEPSEGSAPGTS ESATPESGPGTSTEPSEGSAPGTSESATPESGP GSEPATSGSETPGTSTEPSEGSAPGTSTEPSEG SAPGTSESATPESGPGTSESATPESGPGSPAG SPTSTEEGTSESATPESGPGSEPATSGSETPGT SESATPESGPGTSTEPSEGSAPGTSTEPSEGSA PGTSTEPSEGSAPGTSTEPSEGSAPGTSTEPSE GSAPGTSTEPSEGSAPGSPAGSPTSTEEGTSTE PSEGSAPGTSESATPESGPGSEPATSGSETPG TSESATPESGPGSEPATSGSETPGTSESATPES GPGTSTEPSEGSAPGTSESATPESGPGSPAGS PTSTEEGSPAGSPTSTEEGSPAGSPTSTEEGTS ESATPESGPGTSTEPSEGSAPGTSESATPESGP GSEPATSGSETPGTSESATPESGPGSEPATSG SETPGTSESATPESGPGTSTEPSEGSAPGSPA GSPTSTEEGTSESATPESGPGSEPATSGSETPG TSESATPESGPGSPAGSPTSTEEGSPAGSPTST EEGTSTEPSEGSAPGTSESATPESGPGTSESAT PESGPGTSESATPESGPGSEPATSGPTESGSE PATSGSETPGSPAGSPTSTEEGTSTEPSEGSAP GTSTEPSEGSAPGSEPATSGSETPGTSESATPE SGPGTSTEPSEGSAPGEPEA | 864 |
| 8003 | C-terminal ELNN | 1 | PGSPAGSPTSTEEGTSESATPESGPGTSTEPSE GSAPGSPAGSPTSTEEGTSTEPSEGSAPGTSTE PSEGSAPGTSESATPESGPGSEPATSGSETPG SEPATSGSETPGSPAGSPTSTEEGTSESATPES GPGTSTEPSEGSAPGTSTEPSEGSAPGSPAGS PTSTEEGTSTEPSEGSAPGTSTEPSEGSAPGTS ESATPESGPGTSTEPSEGSAPGTSESATPESGP GSEPATSGSETPGTSTEPSEGSAPGTSTEPSEG SAPGTSESATPESGPGTSESATPESGPGSPAG SPTSTEEGTSESATPESGPGSEPATSGSETPGT SESATPESGPGTSTEPSEGSAPGTSTEPSEGSA | 864 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | PGTSTEPSEGSAPGTSTEPSEGSAPGTSTEPSE GSAPGTSTEPSEGSAPGSPAGSPTSTEEGTSTE PSEGSAPGTSESATPESGPGSEPATSGSETPG TSESATPESGPGSEPATSGSETPGTSESATPES GPGTSTEPSEGSAPGTSESATPESGPGSPAGS PTSTEEGSPAGSPTSTEEGSPAGSPTSTEEGTS ESATPESGPGTSTEPSEGSAPGTSESATPESGP GSEPATSGSETPGTSESATPESGPGSEPATSG SETPGTSESATPESGPGTSTEPSEGSAPGSPA GSPTSTEEGTSESATPESGPGSEPATSGSETPG TSESATPESGPGSPAGSPTSTEEGSPAGSPTST EEGTSTEPSEGSAPGTSESATPESGPGTSESAT PESGPGTSESATPESGPGSEPATSGSETPGSE PATSGSETPGSPAGSPTSTEEGTSTEPSEGSAP GTESTPSEGSAPGSEPATSGSETPGTSESATPE SGPGTSTEPSEGSAPGEPEA | |
| 8004 | N-terminal ELNN | 2 | ASSPAGSPTSTESGTSESATPESGPGTETEPSE GSAPGTSESATPESGPGSEPATSGSETPGTSE SATPESGPGSTPAESGSETPGTSESATPESGP GTSTEPSEGSAPGSPAGSPTSTEEGTSESATPE SGPGESPATSGSTPEGTSESATPESGPGSPAG SPTSTEEGSPAGSPTSTEEGTSTEPSEGSAPGT SESATPESGPGTSESATPESGPGTSESATPESG PGSEPATSGSETPGSEPATSGSETPGSPAGSP TSTEEGTSTEPSEGSAPGTSTEPSEGSAPGGSA P | 288 |
| 8005 | N-terminal ELNN | 1 | ASSPAGSPTSTESGTSESATPESGPGTSTEPSE GSAPGTSESATPESGPGSEPATSGSETPGTSE SATPESGPGSEPATSGSETPGTSESATPESGP GTSTEPSEGSAPGSPAGSPTSTEEGTSESATPE SGPGESPATSGSTPEGTSESATPESGPGSPAG SPTSTEEGSPAGSPTSTEEGTSTEPSEGSAPGT SESATPESGPGTSESATPESGPGTSESATPESG PGSEPATSGSETPGSEPATSGSETPGSPAGSP TSTEEGTSTEPSEGSAPGTSTEPSEGSAPGGSA P | 288 |
| 8006 | N-terminal ELNN | 1 | ASSPAGSPTSTESGTSESATPESGPGTSTEPSE GSAPGTSESATPESGPGSEPATSGSETPGTSE SATPESGPGSTPAESGSETPGTSESATPESGP GTSTEPSEGSAPGSPAGSPTSTEEGTSESATPE SGPGEEPATSGSTPEGTSESATPESGPGSPAG SPTSTEEGSPAGSPTSTEEGTSTEPSEGSAPGT SESATPESGPGTSESATPESGPGTSESATPESG PGSEPATSGSETPGSEPATSGSETPGSPAGSP TSTEEGTSTEPSEGSAPGTSTEPSEGSAPGGSA P | 288 |
| 8007 | N-terminal ELNN | 1 | ASSPAGSPTSTESGTSESATPESGPGTSTEPSE GSAPGTSESATPESGPGSEPATSGSETPGTSE SATPESGPGSTPAESGSETPGTSESATPESGP GTSTEPSEGSAPGSPAGSPTSTEEGTSESATPE SGPGSEPATSGSETPGTSESATPESGPGSPAG SPTSTEEGSPAGSPTSTEEGTSTEPSEGSAPGT SESATPESGPGTSESATPESGPGTSESATPESG PGSEPATSGSETPGSEPATSGSETPGSPAGSP TSTEEGTSTEPSEGSAPGTSTEPSEGSAPGGSA P | 288 |
| 8008 | C-terminal ELNN | 1 | PGSPAGSPTSTEEGTSESATPESGPGTSTEPSE GSAPGSPAGSPTSTEEGTSTEPSEGSAPGTSTE PSEGSAPGTSESATPESGPGSEPATSGSETPG SEPATSGSETPGSPAGSPTSTEEGTSESATPES GPGTSTEPSEGSAPGTSTEPSEGSAPGSPAGS PTSTEEGTSTEPSEGSAPGTSTEPSEGSAPGTS ESATPESGPGTSTEPSEGSAPGTSESATPESGP GSEPATSGSETPGTSTEPSEGSAPGTSTEPSEG SAPGTSESATPESGPGTSESATPESGPGSPAG SPTSTEEGTSESATPESGPGSEPATSGSETPGT SESATPESGPGTSTEPSEGSAPGTSTEPSEGSA PGTSTEPSEGSAPGTSTEPSEGSAPGTSTEPSE GSAPGTSTEPSEGSAPGSPAGSPTSTEEGTSTE | 864 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | PSEGSAPGTSESATPESGPGSEPATSGSETPG TSESATPESGPGSEPATSGSETPGTSESATPES GPGTSTEPSEGSAPGTSESATPESGPGSPAGS PTSTEEGSPAGSPTSTEEGSPAGSPTSTEEGTS ESATPESGPGTSTEPSEGSAPGTSESATPESGP GSEPATSGSETPGTSESATPESGPGSEPATSG SETPGTSESATPESGPGTSTEPSEGSAPGSPA GSPTSTEEGTSESATPESGPGSEPATSGSETPG TSESATPESGPGSPAGSPTSTEEGSPAGSPTST EEGTSTEPSEGSAPGTSESATPESGPGTSESAT PESGPGTSESATPESGPGSEPATSGSETPGSE PATSGSETPGSPAGSPTSTEEGTSTEPSEGSAP GTESTPSEGSAPGSEPATSGSETPGTSESATPE SGPGTSTEPSEGSAPG | |
| 8009 | C-terminal ELNN | 1 | PGSPAGSPTSTEEGTSESATPESGPGSEPATS GSETPGTSESATPESGPGTSTEPSEGSAPGTST EPSEGSAPGTSTEPSEGSAPGTSTEPSEGSAP GTSTEPSEGSAPGTSTEPSEGSAPGSPAGSPT STEEGTSTEPSEGSAPGTSESATPESGPGSEPA TSGSETPGTSESATPESGPGSEPATSGSETPGT SESATPESGPGTSTEPSEGSAPGTSESATPESG PGSPAGSPTSTEEGSPAGSPTSTEEGSPAGSP TSTEEGTSESATPESGPGTSTEPSEGSAPGTSE SATPESGPGSEPATSGSETPGTSESATPESGP GSEPATSGSETPGTSESATPESGPGTSTEPSEG SAPGSPAGSPTSTEEGTSESATPESGPGSEPAT SGSETPGTSESATPESGPGSPAGSPTSTEEGS PAGSPTSTEEGTSTEPSEGSAPGTSESATPESG PGTSESATPESGPGTSESATPESGPGSEPATS GSETPGSEPATSGSETPGSPAGSPTSTEEGTST EPSEGSAPGTESTPSEGSAPGSEPATSGSETP GTSESATPESGPGTSTEPSEGSAPG | 576 |
| 8010 | N-terminal ELNN | 2 | SAGSPGSPAGSPTSTEEGTSESATPESGPGTST EPSEGSAPGSPAGSPTSTEEGTSTEPSEGSAP GTSTEPSEGSAPGTSESATPESGPGSTPAESG SETPGSEPATSGSETPGSPAGSPTSTEEGTSES ATPESGPGTSTEPSEGSAPGTSTEPSEGSAPG SPAGSPTSTEEGTSTEPSEGSAPGTSTEPSEGS APGTSESATPESGPGTSTEPSEGSAPGTSESAT PESGPGSEPATSGSTETPGTSTEPSEGSAPGT STEPSEGSAPGTSESATPESGPGTSESATPESG PGSPAGSPTSTEEGTSESATPESGPGSEPATS GSETPGTSESATPESGPGTSTEPSEGSAPGTST EPSEGSAPGTSTEPSEGSAPGTSTEPSEGSAP GTSTEPSEGSAPGTSTEPSEGSAPGSPAGSPT STEEGTSTEPSEGSAPGTSESATPESGPGSEPA TSGSETPGTSESATPESGPGSEPATSGSETPGT SESATPESGPGTSTEPSEGSAPGTSESATPESG PGSPAGSPTSTEEGSPAGSPTSTEEGSPAGSP TSTEEGTSESATPESGPGTSTEPSEGSAPGTSE SATPESGPGSEPATSGSETPGTSESATPESGP GSEPATSGSETPGTSESATPESGPGTSTEPSEG SAPGSPAGSPTSTEEGTSESATPESGPGSEPAT SGSETPGTSESATPESGPGSPAGSPTSTEEGS PAGSPTSTEEGTSTEPSEGSAPGTSESATPESG PGTSESATPESGPGTSESATPESGPGSEPATS GSETPGSEPATSGSETPGSPAGSPTSTEEGTST EPSEGSAPGTSTEPSEGSAPGSEPATSGSETP GTSESATPESGPGTSTEPSEGSAPGSPAGSPT STEEGTSESATPESGPGTSTEPSEGSAPGSPA GSPTSTEEGTSTEPSEGSAPGTSTEPSEGSAPG TSESATPESGPGSEPATSGSETPGSEPATSGSE TPGSPAGSPTSTEEGTSESATPESGPGTSTEPS EGSAPGTSTEPSEGSAPGSPAGSPTSTEEGTST EPSEGSAPGTSTEPSEGSAPGTSESATPESGP GTSTEPSEGSAPGTSESATPESGPGSEPATSG SETPGTSTEPSEGSAPGTSTEPSEGSAPGTSES ATPESGPGTSESAS | 1152 |
| 8011 | C-terminal ELNN | 3 | SAGSPGSPAGSPTSTEEGTSESATPESGPGTST EPSEGSAPGSPAGSPTSTEEGTSTEPSEGSAP GTSTEPSEGSAPGTSESATPESGPGSEPATSG | 1152 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | SETPGSEPATSGSETPGSPAGSPTSTEEGTSES ATPESGPGTSTEPSEGSAPGTSTEPSEGSAPG SPAGSPTSTEEGTSTEPSEGSAPGTSTEPSEGS APGTSESATPESGPGTSTEPSEGSAPGTSESAT PESGPGSEPATSGSETPGTSTEPSEGSAPGTST EPSEGSAPGTSESATPESGPGTSESATPESGP GSPAGSPTSTEEGTSESATPESGPGSEPATSG SETPGTSESATPESGPGTSTEPSEGSAPGTSTE PSEGSAPGTSTEPSEGSAPGTSTEPSEGSAPG TSTEPSEGSAPGTSTEPSEGSAPGSPAGSPTST EEGTSTEPSEGSAPGTSESATPESGPGSEPATS GSETPGTSESATPESGPGSEPATSGSETPGTSE SATPESGPGTSTEPSEGSAPGTSESATPESGP GSPAGSPTSTEEGSPAGSPTSTEEGSPAGSPT STEEGTSESATPESGPGTSTEPSEGSAPGTSES ATPESGPGSEPATSGSETPGTSESATPESGPG SEPATSGSETPGTSESATPESGPGTSTEPSEGS APGSPAGSPTSTEEGTSESATPESGPGSEPATS GSETPGTSESATPESGPGSPAGSPTSTEEGSP AGSPTSTEEGTSTEPSEGSAPGTSESATPESGP GTSESATPESGPGTSESATPESGPGSEPATSG SETPGSEPATSGSETPGSPAGSPTSTEEGTSTE PSEGSAPGTSTEPSEGSAPGSEPATSGSETPG TSESATPESGPGTSTEPSEGSAPGSPAGSPTST EEGTSESATPESGPGTSTEPSEGSAPGSPAGS PTSTEEGTSTEPSEGSAPGTSTEPSEGSAPGTS ESATPESGPGSEPATSGSETPGSEPATSGSTET PGSPAGSPTSTEEGTSESATPESGPGTSTEPSE GSAPGTSTEPSEGSAPGSPAGSPTSTEEGTSTE PSEGSAPGTATESPEGSAPGTSESATPESGPG TSTEPSEGSAPGTSAESATPESGPGSEPATSG SETPGTSTEPSEGSAPGTSTEPSEGSAPGTSES ATPESGPGTESAS | |
| 8012 | N-terminal ELNN | 2 | GSPAGSPTSTEEGTSESATPESGPGTSTEPSEG SAPGSPAGSPTSTEEGTSTEPSEGSAPGTSTEP SEGGSAPATSESATPESGPGSEPATSGSETPGS EPATSGSETPGSPAGSPTSTEEGTSESASPESG PGTSTEPSEGSAPGTSTEPSEGSAPGSPAGSP TSTEEGTSTEPSEGSAPGTSTEPSEGSAPGTSE SATPESGPGTSTEPSEGSAPGTSESATPESGP GSEPATSGSETPGTSTEPSEGSAPGTSTEPSEG SAPGTSESATPESGPGTSESATPESGPGSPAG SPTSTEEGTSESATPESGPGSEPATSGSETPGT SESATPESGPGTSTEPSEGSAPGTSTEPSEGSA PGTSTEPSEGSAPGTSTEPSEGSAPGTSTEPSE GSAPGTSTEPSEGSAPGSPAGSPTSTEEGTSTE PSEGSAPGTSESATPESGPGSEPATSGSETPG TSESATPESGPGSEPATSGSETPGTSESATPES GPGTSTEPSEGSAPGTSESATPESGPGSPAGS PTSTEEGSPAGSPTSTEEGSPAGSPTSTEEGTS ESATPESGPGTSTEPSEGSAPGTSESATPESGP GSEPATSGSETPGTSESATPESGPGSEPATSG SETPGTSESATPESGPGTSTEPSEGSAPGSPA GSPTSTEEGTSESATPESGPGSEPATSGSETPG TSESATPESGPGSPAGSPTSTEEGSPAGSPTST EEGTSTEPSEGSAPGTSESATPESGPGTSESAT PESGPGTSESATPESGPGSEPATSGSETPGSE PATSGSETPGSPAGSPTSTEEGTSTEPSEGSAP GTSTEPSEGSAPGSEPATSGSETPGTSESATPE SGPGTSTEPSEGSAP | 864 |
| 8013 | N-terminal ELNN | 1 | GSPAGSPTSTEEGTSESATPESGPGTSTEPSEG SAPGSPAGSPTSTEEGTSTEPSEGSAPGTSTEP SEGSAPGTSESATPESGPGSESATSGSETPGS EPATSGSETPGSPAGSPTSTEEGTSESATPESG PGTSTEPSEGSAPGTSTEPSEGSAPGSPAGSP TSTEEGTSTEPSEGSAPGTSTEPSEGSAPGTSE SATPESGPGTSTEPSEGSAPGTSESATPESGP GSEPATSGSETPGTSTEPSEGSAPGTSTEPSEG SAPGTSESATPESGPGTSESATPESGPGSPAG SPTSTEEGTSESATPESGPGSEPATSGSETPGT SESATPESGPGTSTEPSEGSAPGTSTEPSEGSA PGTSTEPSEGSAPGTSTEPSEGSAPGTSTEPSE | 864 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | GSAPGTSTEPSEGSAPGSPAGSPTSTEEGTSTE PSEGSAPGTSESATPESGPGSEPATSGSETPG TSESATPESGPGSEPATSGSETPGTSESATPES GPGTSTEPSEGSAPGTSESATPESGPGSPAGS PTSTEEGSPAGSPTSTEEGSPAGSPTSTEEGTS ESATPESGPGTSTEPSEGSAPGTSESATPESGP GSEPATSGSETPGTSESATPESGPGSEPATSG SETPGTSESATPESGPGTSTEPSEGSAPGSPA GSPTSTEEGTSESATPESGPGSEPATSGSETPG TSESATPESGPGSPAGSPTSTEEGSPAGSPTST EEGTSTEPSEGSAPGTSESATPESGPGTSESAT PESGPGTSESATPESGPGSEPATSGSETPGSE PATSGSETPGSPAGSPTSTEEGTSTEPSEGSAP GTSTEPSEGSAPGSEPATSGSETPGTSESATPE SGPGTSTEPSEGSAP | |
| 8014 | N-terminal ELNN | 1 | SPAGSPTSTESGTSESATPESGPGTSTEPSEGS APGTSESATPESGPGSEPATSGSETPGTSESAT PESGPGSTPAESGSETPGTSESATPESGPGTS TEPSEGSAPGSPAGSPTSTEEGTSESATPESGP GSEPATSGSETPGTSESATPESGPGSPAGSPT STEEGSPAGSPTSTEEGTSTEPSEGSAPGTSES ATPESGPGTSESATPESGPGTSESATPESGPG SEPATSGSETPGSEPATSGSETPGSPAGSPTST EEGTSTEPSEGSAPGTSTEPSEGSAPGGSAP | 292 |
| 8015 | C-terminal ELNN | 1 | PGSPAGSPTSTEEGTSESATPESGPGSEPATS GSETPGTSESATPESGPGTSTEPSEGSAPGTST EPSEGSAPGTSTEPSEGSAPGTSTEPSEGSAP GTSTEPSEGSAPGTSTEPSEGSAPGSPAGSPT STEEGTSTEPSEGSAPGTSESATPESGPGSEPA TSGSETPGTSESATPESGPGSEPATSGSETPGT SESATPESGPGTSTEPSEGSAPGTSESATPESG PGSPAGSPTSTEEGSPAGSPTSTEEGSPAGSP TSTEEGTSESATPESGPGTSTEPSEGSAPGTSE SATPESGPGSEPATSGSETPGTSESATPESGP GSEPATSGSETPGTSESATPESGPGTSTEPSEG SAPGSPAGSPTSTEEGTSESATPESGPGSEPAT SGSETPGTSESATPESGPGSPAGSPTSTEEGS PAGSPTSTEEGTSTEPSEGSAPGTSESATPESG PGTSESATPESGPGTSESATPESGPGSEPATS GSETPGSEPATSGSETPGSPAGSPTSTEEGTST EPSEGSAPGTESTPSEGSAPGSEPATSGSETP GTSESATPESGPGTSTEPSEGSAPGEPEA | 582 |
| 8016 | C-terminal ELNN | 1 | TPESGPGTSESATPESGPGSPAGSPTSTEEGTS ESATPESGPGSEPATSGSETPGTSESATPESGP GTSTEPSEGSAPGTSTEPSEGSAPGTSTEPSEG SAPGTSTEPSEGSAPGTSTEPSEGSAPGTSTEP SEGSAPGSPAGSPTSTEEGTSTEPSEGSAPGT SESATPESGPGSEPATSGSETPGTSESATPESG PGSEPATSGSETPGTSESATPESGPGTSTEPSE GSAPGTSESATPESGPGSPAGSPTSTEEGSPA GSPTSTEEGSPAGSPTSTEEGTSESATPESGPG TSTEPSEGSAPGTSESATPESGPGSEPATSGSE TPGTSESATPESGPGSEPATSGSETPGTSESAT PESGPGTSTEPSEGSAPGSPAGSPTSTEEGTS ESATPESGPGSEPATSGSETPGTSESATPESGP GSPAGSPTSTEEGSPAGSPTSTEEGTSTEPSEG SAPGTSESATPESGPGTSESATPESGPGTSESA TPESGPGSEPATSGSETPGSESATSGSETPGS PAGSPTSTEEGTSTEPSEGSAPGTSTEPSEGSA PGSEPATSGSETPGTSESA | 576 |
| 8017 | C-terminal ELNN | 1 | GTSTEPSEGSAPGTSESATPESGPGSEPATSG SETPGSEPATSGSETPGSPAGSPTSTEEGTSES ATPESGPGTSTEPSEGSAPGTSTEPSEGSAPG SPAGSPTSTEEGTSTEPSEGSAPGTSTEPSEGS APGTSESATPESGPGTSTEPSEGSAPGTSESAT PESGPGSEPATSGSETPGTSTEPSEGSAPGTST EPSEGSAPGTSESATPESGPGTSESATPESGP GSPAGSPTSTEEGTSESATPESGPGSEPATSG SETPGTSESATPESGPGTSTEPSEGSAPGTSTE PSEGSAPGTSTEPSEGSAPGTSTEPSEGSAPG | 576 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | TSTEPSEGSAPGTSTEPSEGSAPGSPAGSPTST EEGTSTEPSEGSAPGTSESATPESGPGSEPATS GSETPGTSESATPESGPGSEPATSGSETPGTSE SATPESGPGTSTEPSEGSAPGTSESASPESGP GSPAGSPTSTEEGSPAGSPTSTEEGSPAGSPT STEEGTSESATPESGPGTSTEPSEGSAPGTSES ATPESGPGSEPATSGSETPGTSESATPESGPG SEPATSGSETPGTSESATPESGP | |
| 8018 | C-terminal ELNN | 1 | GSETPGSPAGSPTSTEEGTSESATPESGPGTST EPSEGSAPGTSTEPSEGSAPGSPAGSPTSTEE GTSTEPSEGSAPGTSTEPSEGSAPGTSESATPE SGPGTSTEPSEGSAPGTSESATPESGPGSEPA TSGSETPGTSTEPSEGSAPGTSTEPSEGSAPGT SESATPESGPGTSESATPESGPGSPAGSPTSTE EGTSESATPESGPGSEPATSGSETPGTSESATP ESGPGTSTEPSEGSAPGTSTEPSEGSAPGTSTE PSEGSAPGTSTEPSEGSAPGTSTEPSEGSAPG TSTEPSEGSAPGSPAGSPTSTEEGTSTEPSEGS APGTSESATPESGPGSEPATSGSETPGTSESAT PESGPGSEPATSGSETPGTSESATPESGPGTST EPSEGSAPGTSESATPESGPGSPAGSPTSTEE GSPAGSPTSTEEGSPAGSPTSTEEGTSESATPE SGPGTSTEPSEGSAPGTSESATPESGPGSEPA TSGSTETGTSESATPESGPGSEPATSGSETPGT SESATPESGPGTSTEPSEGSAPGSPAGSPTSTE EGTSESATPESGPGSEPATS | 576 |
| 8019 | C-terminal ELNN | 1 | EGSAPGTSTEPSEGSAPGTSESATPESGPGTST EPSEGSAPGTSESATPESGPGSEPATSGSETP GTSTEPSEGSAPGTSTEPSEGSAPGTSESATPE SGPGTSESATPESGPGSPAGSPTSTEEGTSES ATPESGPGSEPATSGSETPGTSESATPESGPGT STEPSEGSAPGTSTEPSEGSAPGTSTEPSEGSA PGTSTEPSEGSAPGTSTEPSEGSAPGTSTEPSE GSAPGSPAGSPTSTEEGTSTEPSEGSAPGTSE SATPESGPGSEPATSGSETPGTSESATPESGP GSEPATSGSETPGTSESATPESGPGTSTEPSEG SAPGTSESATPESGPGSPAGSPTSTEEGSPAG SPTSTEEGSPAGSPTSTEEGTSESATPESGPGT STEPSEGSAPGTSESATPESGPGSEPATSGSET PGTSESATPESGPGSEPATSGSETPGTSESASP ESGPGTSTEPSEGSAPGSPAGSPTSTEEGTSE SATPESGPGSEPATSGSETPGTSESATPESGP GSPAGSPTSTEEGSPAGSPTSTEEGTSTEPSEG SAPGTSESATPESGPGTSESAT | 576 |
| 8020 | N-terminal ELNN | 1 | ASSPAGSPTSTESGTSESATPESGPGTSTEPSE GSAPGTSESATPESGPGSEPATSGSETPGTSE SATPESGPGSTPAESGSETPGTSESATPESGP GTSTEPSEGSAPGSPAGSPTSTEEGTSESATPE SGPGSEPATSGSETPGTSESATPESGPGSPAG SPTSTEEGSPAGSPTSTEEGTSTEPSEGSAPGT SESATPESGPGTSESATPESGPGTSESATPESG PGSEPATSGSETPGSEPATSGSETPGSPAGSP TSTEEGTSTEPSEGSAPGTSTEPSEGSAPGGSA P | 294 |
| 8021 | N-terminal ELNN | 1 | ASSATPESGPGTSTEPSEGSAPGTSESATPESG PGSGPGTSESATPGTSESATPESGPGSEPATS GSETPGTSESATPESGPGTSTEPSEGSAPGSP AGSPTSTEEGTSESATPESGPGSEPATSGSETP GTSESATPESGPGSPAGSPTSTEEGSPAGSPT STEEGTSTEPSEGSAPGTSESATPESGPGTSES ATPESGPGTSESATPESGPGSEPATSGSETPG SEPATSGSETPGSPAGSPTSTEEGTSTEPSEGS APGTSTEPSEGSAPGSEPATSGSETPGTSESAT P | 294 |
| 8022 | C-terminal ELNN | 1 | ATPESGPGTSESATPESGPGSPAGSPTSTEEGT SESATPESGPGSEPATSGSETPGTSESATPESG PGTSTEPSEGSAPGTSTEPSEGSAPGTSTEPSE GSAPGTSTEPSEGSAPGTSTEPSEGSAPGTSTE PSEGSAPGSPAGSPTSTEEGTSTEPSEGSAPG | 582 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | TSESATPESGPGSEPATSGSETPGTSESATPES GPGSEPATSGSETPGTSESATPESGPGTSTEPS EGSAPGTSESATPESGPGSPAGSPTSTEEGSP AGSPTSTEEGSPAGSPTSTEEGTSESATPESGP GTSTEPSEGSAPGTSESATPESGPGSEPATSG SETPGTSESATPESGPGSEPATSGSETPGTSES ATPESGPGTSTEPSEGSAPGSPAGSPTSTEEGT SESATPESGPGSEPATSGSETPGTSESATPESG PGSPAGSPTSTEEGSPAGSPTSTEEGTSTEPSE GSAPGTSESATPESGPGTSESATPESGPGTSP SATPESGPGSEPATSGSETPGSEPATSGSETP GSPAGSPTSTEEGTSTEPSEGSAPGTSTEPSEG SAPGSEPATSGSETPGTSESAGEPEA | |

In some embodiments, a barcoded ELNN can be obtained by making one or more mutations to existing ELNN, such as any listed in Table 3b, according to one or more of the following criteria: to minimize the sequence change in the ELNN, to minimize the amino acid composition change in the ELNN, to substantially maintain the net charge of the ELNN, to substantially maintain (or improve) low immunogenicity of the ELNN, and to substantially maintain (or improve) the pharmacokinetic properties of the ELNN. In some embodiments, the ELNN sequence has at least 90%, at least 92%, at least 95%, at least 98%, at least 99%, or 100% sequence identity to any one of SEQ ID NOs: 601-659 listed in Table 3b. In some embodiments, the ELNN sequence, having at least 90% (e.g., at least 92%, at least 95%, at least 98%, or at least 99%) but less than 100% sequence identity to any of SEQ ID NOs: 601-659 listed in Table 3b, is obtained by one or more mutations (e.g., less than 10, less than 8, less than 6, less than 5, less than 4, less than 3, less than 2 mutations) of the corresponding sequence from Table 3b. In some embodiments, the one or more mutations comprise deletion of a glutamic acid residue, insertion of a glutamic acid residue, substitution of a glutamic acid residue, or substitution for a glutamic acid residue, or any combination thereof. In some embodiments, where the ELNN sequence differs from, but has at least 90% (e.g., at least 92%, at least 95%, at least 98%, or at least 99%) sequence identity to, any one of SEQ ID NOs: 601-659 listed in Table 3b, at least 80%, at least 90%, at least 95%, at least 97%, or about 100% of the difference between the ELNN sequence and the corresponding sequence of Table 3b involve deletion of a glutamic acid residue, insertion of a glutamic acid residue, substitution of a glutamic acid residue, or substitution for a glutamic acid residue, or any combination thereof. In some such embodiments, at least 80%, at least 90%, at least 95%, at least 97%, or about 100% of the difference between the ELNN sequence and the corresponding sequence of Table 3b involve a substitution of a glutamic acid residue, or a substitution for a glutamic acid residue, or both.

The "a substitution of a first amino acid," as used herein, refers to replacement of the first amino acid residue with a second amino acid residue, resulting in the second amino acid residue taking its place at the substitution position in the obtained sequence. For example, "a substitution of glutamic acid" refers to replacement of the glutamic acid (E) residue for a non-glutamic acid residue (e.g., serine (S)).

TABLE 3b

Exemplary Existing ELNNs for Engineering into Barcoded ELNN(s)

| ELNN Name | Amino Acid Sequence | SEQ ID NO: |
|---|---|---|
| AE144 | GSEPATSGSETPGTSESATPESGPGSEPATSGSETPGSPAGSPT STEEGTSTEPSEGSAPGSEPATSGSETPGSEPATSGSETPGSEP ATSGSETPGTSTEPSEGSAPGTSESATPESGPGSEPATSGSETP GTSTEPSEGSAP | 601 |
| AE144_1A | SPAGSPTSTEEGTSESATPESGPGTSTEPSEGSAPGSPAGSPTS TEEGTSTEPSEGSAPGTSTEPSEGSAPGTSESATPESGPGSEPA TSGSETPGSEPATSGSETPGSPAGSPTSTEEGTSESATPESGPG TSTEPSEGSAPG | 602 |
| AE144_2A | TSTEPSEGSAPGSPAGSPTSTEEGTSTEPSEGSAPGTSTEPSEG SAPGTSESATPESGPGTSTEPSEGSAPGTSESATPESGPGSEPA TSGSETPGTSTEPSEGSAPGTSTEPSEGSAPGTSESATPESGPG TSESATPESGPG | 603 |
| AE144_2B | TSTEPSEGSAPGSPAGSPTSTEEGTSTEPSEGSAPGTSTEPSEG SAPGTSESATPESGPGTSTEPSEGSAPGTSESATPESGPGSEPA TSGSETPGTSTEPSEGSAPGTSTEPSEGSAPGTSESATPESGPG TSESATPESGPG | 604 |

TABLE 3b-continued

Exemplary Existing ELNNs for Engineering into Barcoded ELNN(s)

| ELNN Name | Amino Acid Sequence | SEQ ID NO: |
|---|---|---|
| AE144_3A | SPAGSPTSTEEGTSESATPESGPGSEPATSGSETPGTSESATPE SGPGTSTEPSEGSAPGTSTEPSEGSAPGTSTEPSEGSAPGTSTE PSEGSAPGTSTEPSEGSAPGTSTEPSEGSAPGSPAGSPTSTEEG TSTEPSEGSAPG | 605 |
| AE144_3B | SPAGSPTSTEEGTSESATPESGPGSEPATSGSETPGTSESATPE SGPGTSTEPSEGSAPGTSTEPSEGSAPGTSTEPSEGSAPGTSTE PSEGSAPGTSTEPSEGSAPGTSTEPSEGSAPGSPAGSPTSTEEG TSTEPSEGSAPG | 606 |
| AE144_4A | TSESATPESGPGSEPATSGSETPGTSESATPESGPGSEPATSGS ETPGTSESATPESGPGTSTEPSEGSAPGTSESATPESGPGSPAG SPTSTEEGSPAGSPTSTEEGSPAGSPTSTEEGTSESATPESGPG TSTEPSEGSAPG | 607 |
| AE144_4B | TSESATPESGPGSEPATSGSETPGTSESATPESGPGSEPATSGS ETPGTSESATPESGPGTSTEPSEGSAPGTSESATPESGPGSPAG SPTSTEEGSPAGSPTSTEEGSPAGSPTSTEEGTSESATPESGPG TSTEPSEGSAPG | 608 |
| AE144_5A | TSESATPESGPGSEPATSGSETPGTSESATPESGPGSEPATSGS ETPGTSESATPESGPGTSTEPSEGSAPGSPAGSPTSTEEGTSES ATPESGPGSEPATSGSETPGTSESATPESGPGSPAGSPTSTEEG SPAGSPTSTEEG | 609 |
| AE144_6B | TSTEPSEGSAPGTSESATPESGPGTSESATPESGPGTSESATPE SGPGSEPATSGSETPGSEPATSGSETPGSPAGSPTSTEEGTSTE PSEGSAPGTSTEPSEGSAPGSEPATSGSETPGTSESATPESGPG TSTEPSEGSAPG | 610 |
| AE288_1 | GTSESATPESGPGSEPATSGSETPGTSESATPESGPGSEPATSG SETPGTSESATPESGPGTSTEPSEGSAPGSPAGSPTSTEEGTSE SATPESGPGSEPATSGSETPGTSESATPESGPGSPAGSPTSTEE GSPAGSPTSTEEGTSTEPSEGSAPGTSESATPESGPGTSESATP ESGPGTSESATPESGPGSEPATSGSETPGSEPATSGSETPGSPA GSPTSTEEGTSTEPSEGSAPGTSTEPSEGSAPGSEPATSGSETP GTSESATPESGPGTSTEPSEGSAP | 611 |
| AE288_2 | GSPAGSPTSTEEGTSESATPESGPGSEPATSGSETPGTSESATP ESGPGTSTEPSEGSAPGTSTEPSEGSAPGTSTEPSEGSAPGTST EPSEGSAPGTSTEPSEGSAPGTSTEPSEGSAPGSPAGSPTSTEE GTSTEPSEGSAPGTSESATPESGPGSEPATSGSETPGTSESATP ESGPGSEPATSGSETPGTSESATPESGPGTSTEPSEGSAPGTSE SATPESGPGSPAGSPTSTEEGSPAGSPTSTEEGSPAGSPTSTEE GTSESATPESGPGTSTEPSEGSAP | 612 |
| AE576 | GSPAGSPTSTEEGTSESATPESGPGTSTEPSEGSAPGSPAGSPT STEEGTSTEPSEGSAPGTSTEPSEGSAPGTSESATPESGPGSEP ATSGSETPGSEPATSGSETPGSPAGSPTSTEEGTSESATPESGP GTSTEPSEGSAPGTSTEPSEGSAPGSPAGSPTSTEEGTSTEPSE GSAPGTSTEPSEGSAPGTSESATPESGPGTSTEPSEGSAPGTSE SATPESGPGSEPATSGSETPGTSTEPSEGSAPGTSTEPSEGSAP GTSESATPESGPGTSESATPESGPGSPAGSPTSTEEGTSESATP ESGPGSEPATSGSETPGTSESATPESGPGTSTEPSEGSAPGTST EPSEGSAPGTSTEPSEGSAPGTSTEPSEGSAPGTSTEPSEGSAP GTSTEPSEGSAPGSPAGSPTSTEEGTSTEPSEGSAPGTSESATP ESGPGSEPATSGSETPGTSESATPESGPGSEPATSGSETPGTSE SATPESGPGTSTEPSEGSAPGTSESATPESGPGSPAGSPTSTEE GSPAGSPTSTEEGSPAGSPTSTEEGTSESATPESGPGTSTEPSE GSAP | 613 |
| AE624 | MAEPAGSPTSTEEGTPGSGTASSSPGSSTPSGATGSPGASPGTS STGSPGSPAGSPTSTEEGTSESATPESGPGTSTEPSEGSAPGSP AGSPTSTEEGTSTEPSEGSAPGTSTEPSEGSAPGTSESATPESG PGSEPATSGSETPGSEPATSGSETPGSPAGSPTSTEEGTSESAT PESGPGTSTEPSEGSAPGTSTEPSEGSAPGSPAGSPTSTEEGTS TEPSEGSAPGTSTEPSEGSAPGTSESATPESGPGTSTEPSEGSA PGTSESATPESGPGSEPATSGSETPGTSTEPSEGSAPGTSTEPS EGSAPGTSESATPESGPGTSESATPESGPGSPAGSPTSTEEGTS ESATPESGPGSEPATSGSETPGTSESATPESGPGTSTEPSEGSA | 614 |

TABLE 3b-continued

Exemplary Existing ELNNs for Engineering into Barcoded ELNN(s)

| ELNN Name | Amino Acid Sequence | SEQ ID NO: |
|---|---|---|
| | PGTSTEPSEGSAPGTSTEPSEGSAPGTSTEPSEGSAPGTSTEPS<br>EGSAPGTSTEPSEGSAPGSPAGSPTSTEEGTSTEPSEGSAPGTS<br>ESATPESGPGSEPATSGSETPGTSESATPESGPGSEPATSGSET<br>PGTSESATPESGPGTSTEPSEGSAPGTSESATPESGPGSPAGSP<br>TSTEEGSPAGSPTSTEEGSPAGSPTSTEEGTSESATPESGPGTS<br>TEPSEGSAP | |
| AE864 | GSPAGSPTSTEEGTSESATPESGPGTSTEPSEGSAPGSPAGSPT<br>STEEGTSTEPSEGSAPGTSTEPSEGSAPGTSESATPESGPGSEP<br>ATSGSETPGSEPATSGSETPGSPAGSPTSTEEGTSESATPESGP<br>GTSTEPSEGSAPGTSTEPSEGSAPGSPAGSPTSTEEGTSTEPSE<br>GSAPGTSTEPSEGSAPGTSESATPESGPGTSTEPSEGSAPGTSE<br>SATPESGPGSEPATSGSETPGTSTEPSEGSAPGTSTEPSEGSAP<br>GTSESATPESGPGTSESATPESGPGSPAGSPTSTEEGTSESATP<br>ESGPGSEPATSGSETPGTSESATPESGPGTSTEPSEGSAPGTST<br>EPSEGSAPGTSTEPSEGSAPGTSTEPSEGSAPGTSTEPSEGSAP<br>GTSTEPSEGSAPGSPAGSPTSTEEGTSTEPSEGSAPGTSESATP<br>ESGPGSEPATSGSETPGTSESATPESGPGSEPATSGSETPGTSE<br>SATPESGPGTSTEPSEGSAPGTSESATPESGPGSPAGSPTSTEE<br>GSPAGSPTSTEEGSPAGSPTSTEEGTSESATPESGPGTSTEPSE<br>GSAPGTSESATPESGPGSEPATSGSETPGTSESATPESGPGSEP<br>ATSGSETPGTSESATPESGPGTSTEPSEGSAPGSPAGSPTSTEE<br>GTSESATPESGPGSEPATSGSETPGTSESATPESGPGSPAGSPT<br>STEEGSPAGSPTSTEEGTSTEPSEGSAPGTSESATPESGPGTSE<br>SATPESGPGTSESATPESGPGSEPATSGSETPGSEPATSGSETP<br>GSPAGSPTSTEEGTSTEPSEGSAPGTSTEPSEGSAPGSEPATSG<br>SETPGTSESATPESGPGTSTEPSEGSAP | 615 |
| AE865 | GGSPAGSPTSTEEGTSESATPESGPGTSTEPSEGSAPGSPAGSP<br>TSTEEGTSTEPSEGSAPGTSTEPSEGSAPGTSESATPESGPGSE<br>PATSGSETPGSEPATSGSETPGSPAGSPTSTEEGTSESATPESG<br>PGTSTEPSEGSAPGTSTEPSEGSAPGSPAGSPTSTEEGTSTEPS<br>EGSAPGTSTEPSEGSAPGTSESATPESGPGTSTEPSEGSAPGTS<br>ESATPESGPGSEPATSGSETPGTSTEPSEGSAPGTSTEPSEGSA<br>PGTSESATPESGPGTSESATPESGPGSPAGSPTSTEEGTSESAT<br>PESGPGSEPATSGSETPGTSESATPESGPGTSTEPSEGSAPGTS<br>TEPSEGSAPGTSTEPSEGSAPGTSTEPSEGSAPGTSTEPSEGSA<br>PGTSTEPSEGSAPGSPAGSPTSTEEGTSTEPSEGSAPGTSESAT<br>PESGPGSEPATSGSETPGTSESATPESGPGSEPATSGSETPGTS<br>ESATPESGPGTSTEPSEGSAPGTSESATPESGPGSPAGSPTSTE<br>EGSPAGSPTSTEEGSPAGSPTSTEEGTSESATPESGPGTSTEPS<br>EGSAPGTSESATPESGPGSEPATSGSETPGTSESATPESGPGSE<br>PATSGSETPGTSESATPESGPGTSTEPSEGSAPGSPAGSPTSTE<br>EGTSESATPESGPGSEPATSGSETPGTSESATPESGPGSPAGSP<br>TSTEEGSPAGSPTSTEEGTSTEPSEGSAPGTSESATPESGPGTS<br>ESATPESGPGTSESATPESGPGSEPATSGSETPGSEPATSGSET<br>PGSPAGSPTSTEEGTSTEPSEGSAPGTSTEPSEGSAPGSEPATS<br>GSETPGTSESATPESGPGTSTEPSEGSAP | 616 |
| AE866 | PGSPAGSPTSTEEGTSESATPESGPGTSTEPSEGSAPGSPAGSP<br>TSTEEGTSTEPSEGSAPGTSTEPSEGSAPGTSESATPESGPGSE<br>PATSGSETPGSEPATSGSETPGSPAGSPTSTEEGTSESATPESG<br>PGTSTEPSEGSAPGTSTEPSEGSAPGSPAGSPTSTEEGTSTEPS<br>EGSAPGTSTEPSEGSAPGTSESATPESGPGTSTEPSEGSAPGTS<br>ESATPESGPGSEPATSGSETPGTSTEPSEGSAPGTSTEPSEGSA<br>PGTSESATPESGPGTSESATPESGPGSPAGSPTSTEEGTSESAT<br>PESGPGSEPATSGSETPGTSESATPESGPGTSTEPSEGSAPGTS<br>TEPSEGSAPGTSTEPSEGSAPGTSTEPSEGSAPGTSTEPSEGSA<br>PGTSTEPSEGSAPGSPAGSPTSTEEGTSTEPSEGSAPGTSESAT<br>PESGPGSEPATSGSETPGTSESATPESGPGSEPATSGSETPGTS<br>ESATPESGPGTSTEPSEGSAPGTSESATPESGPGSPAGSPTSTE<br>EGSPAGSPTSTEEGSPAGSPTSTEEGTSESATPESGPGTSTEPS<br>EGSAPGTSESATPESGPGSEPATSGSETPGTSESATPESGPGSE<br>PATSGSETPGTSESATPESGPGTSTEPSEGSAPGSPAGSPTSTE<br>EGTSESATPESGPGSEPATSGSETPGTSESATPESGPGSPAGSP<br>TSTEEGSPAGSPTSTEEGTSTEPSEGSAPGTSESATPESGPGTS<br>ESATPESGPGTSESATPESGPGSEPATSGSETPGSEPATSGSET<br>PGSPAGSPTSTEEGTSTEPSEGSAPGTSTEPSEGSAPGSEPATS<br>GSETPGTSESATPESGPGTSTEPSEGSAPG | 617 |
| AE1152 | GSPAGSPTSTEEGTSESATPESGPGTSTEPSEGSAPGSPAGSPT<br>STEEGTSTEPSEGSAPGTSTEPSEGSAPGTSESATPESGPGSEP<br>ATSGSETPGSEPATSGSETPGSPAGSPTSTEEGTSESATPESGP<br>GTSTEPSEGSAPGTSTEPSEGSAPGSPAGSPTSTEEGTSTEPSE<br>GSAPGTSTEPSEGSAPGTSESATPESGPGTSTEPSEGSAPGTSE | 618 |

TABLE 3b-continued

Exemplary Existing ELNNs for Engineering into Barcoded ELNN(s)

| ELNN Name | Amino Acid Sequence | SEQ ID NO: |
|---|---|---|
| | SATPESGPGSEPATSGSETPGTSTEPSEGSAPGTSTEPSEGSAP GTSESATPESGPGTSESATPESGPGSPAGSPTSTEEGTSESATP ESGPGSEPATSGSETPGTSESATPESGPGTSTEPSEGSAPGTST EPSEGSAPGTSTEPSEGSAPGTSTEPSEGSAPGTSTEPSEGSAP GTSTEPSEGSAPGSPAGSPTSTEEGTSTEPSEGSAPGTSESATP ESGPGSEPATSGSETPGTSESATPESGPGSEPATSGSETPGTSE SATPESGPGTSTEPSEGSAPGTSESATPESGPGSPAGSPTSTEE GSPAGSPTSTEEGSPAGSPTSTEEGTSESATPESGPGTSTEPSE GSAPGTSESATPESGPGSEPATSGSETPGTSESATPESGPGSEP ATSGSETPGTSESATPESGPGTSTEPSEGSAPGSPAGSPTSTEE GTSESATPESGPGSEPATSGSETPGTSESATPESGPGSPAGSPT STEEGSPAGSPTSTEEGTSTEPSEGSAPGTSESATPESGPGTSE SATPESGPGTSESATPESGPGSEPATSGSETPGSEPATSGSETP GSPAGSPTSTEEGTSTEPSEGSAPGTSTEPSEGSAPGSEPATSG SETPGTSESATPESGPGTSTEPSEGSAPGTSESATPESGPGSEP ATSGSETPGTSESATPESGPGSEPATSGSETPGTSESATPESGP GTSTEPSEGSAPGSPAGSPTSTEEGTSESATPESGPGSEPATSG SETPGTSESATPESGPGSPAGSPTSTEEGSPAGSPTSTEEGTST EPSEGSAPGTSESATPESGPGTSESATPESGPGTSESATPESGP GSEPATSGSETPGSEPATSGSETPGSPAGSPTSTEEGTSTEPSE GSAPGTSTEPSEGSAPGSEPATSGSETPGTSESATPESGPGTST EPSEGSAP | |
| AE144A | STEPSEGSAPGSPAGSPTSTEEGTSTEPSEGSAPGTSESATPES GPGSEPATSGSETPGTSESATPESGPGSEPATSGSETPGTSESA TPESGPGTSTEPSEGSAPGTSESATPESGPGSPAGSPTSTEEGS PAGSPTSTEEGS | 619 |
| AE144B | SEPATSGSETPGTSESATPESGPGSEPATSGSETPGTSESATPE SGPGTSTEPSEGSAPGSPAGSPTSTEEGTSESATPESGPGSEPA TSGSETPGTSESATPESGPGSPAGSPTSTEEGSPAGSPTSTEEG TSTEPSEGSAPG | 620 |
| AE180A | TSTEEGTSESATPESGPGSEPATSGSETPGTSESATPESGPGSP AGSPTSTEEGSPAGSPTSTEEGTSTEPSEGSAPGTSESATPESG PGTSESATPESGPGSESATPESGPGSEPATSGSETPGSEPATS GSETPGSPAGSPTSTEEGTSTEPSEGSAPGTSTEPSEGSAPGSE PATS | 621 |
| AE216A | PESGPGTSTEPSEGSAPGSPAGSPTSTEEGTSESATPESGPGSE PATSGSETPGTSESATPESGPGSPAGSPTSTEEGSPAGSPTSTE EGTSTEPSEGSAPGTSESATPESGPGTSESATPESGPGTSESAT PESGPGSEPATSGSETPGSEPATSGSETPGSPAGSPTSTEEGTS TEPSEGSAPGTSTEPSEGSAPGSEPATSGSETPGTSESAT | 622 |
| AE252A | ESGPGSEPATSGSETPGTSESATPESGPGTSTEPSEGSAPGSPA GSPTSTEEGTSESATPESGPGSEPATSGSETPGTSESATPESGP GSPAGSPTSTEEGSPAGSPTSTEEGTSTEPSEGSAPGTSESATP ESGPGTSESATPESGPGTSESATPESGPGSEPATSGSETPGSEP ATSGSETPGSPAGSPTSTEEGTSTEPSEGSAPGTSTEPSEGSAP GSEPATSGSETPGTSESATPESGPGTSTEPSE | 623 |
| AE288A | TPESGPGTSTEPSEGSAPGTSESATPESGPGSEPATSGSETPGT SESATPESGPGSEPATSGSETPGTSESATPESGPGTSTEPSEGS APGSPAGSPTSTEEGTSESATPESGPGSEPATSGSETPGTSESA TPESGPGSPAGSPTSTEEGSPAGSPTSTEEGTSTEPSEGSAPGT SESATPESGPGTSESATPESGPGTSESATPESGPGSEPATSGSE TPGSEPATSGSETPGSPAGSPTSTEEGTSTEPSEGSAPGTSTEP SEGSAPGSEPATSGSETPGTSESA | 624 |
| AE324A | PESGPGSPAGSPTSTEEGSPAGSPTSTEEGSPAGSPTSTEEGTS ESATPESGPGTSTEPSEGSAPGTSESATPESGPGSEPATSGSET PGTSESATPESGPGSEPATSGSETPGTSESATPESGPGTSTEPS EGSAPGSPAGSPTSTEEGTSESATPESGPGSEPATSGSETPGTS ESATPESGPGSPAGSPTSTEEGSPAGSPTSTEEGTSTEPSEGSA PGTSESATPESGPGTSESATPESGPGTSESATPESGPGSEPATS GSETPGSEPATSGSETPGSPAGSPTSTEEGTSTEPSEGSAPGTS TEPSEGSAPGSEPATS | 625 |
| AE360A | PESGPGTSTEPSEGSAPGTSESATPESGPGSPAGSPTSTEEGSP AGSPTSTEEGSPAGSPTSTEEGTSESATPESGPGTSTEPSEGSA PGTSESATPESGPGSEPATSGSETPGTSESATPESGPGSEPATS GSETPGTSESATPESGPGTSTEPSEGSAPGSPAGSPTSTEEGTS ESATPESGPGSEPATSGSETPGTSESATPESGPGSPAGSPTSTE EGSPAGSPTSTEEGTSTEPSEGSAPGTSESATPESGPGTSESAT | 626 |

TABLE 3b-continued

Exemplary Existing ELNNs for Engineering into Barcoded ELNN(s)

| ELNN Name | Amino Acid Sequence | SEQ ID NO: |
|---|---|---|
| | PESGPGTSESATPESGPGSEPATSGSETPGSEPATSGSETPGSP AGSPTSTEEGTSTEPSEGSAPGTSTEPSEGSAPGSEPATSGSET PGTSESAT | |
| AE396A | PESGPGSEPATSGSETPGTSESATPESGPGTSTEPSEGSAPGTS ESATPESGPGSPAGSPTSTEEGSPAGSPTSTEEGSPAGSPTSTE EGTSESATPESGPGTSTEPSEGSAPGTSESATPESGPGSEPATS GSETPGTSESATPESGPGSEPATSGSETPGTSESATPESGPGTS TEPSEGSAPGSPAGSPTSTEEGTSESATPESGPGSEPATSGSET PGTSESATPESGPGSPAGSPTSTEEGSPAGSPTSTEEGTSTEPS EGSAPGTSESATPESGPGTSESATPESGPGTSESATPESGPGSE PATSGSETPGSEPATSGSETPGSPAGSPTSTEEGTSTEPSEGSA PGTSTEPS | 627 |
| AE432A | EGSAPGSPAGSPTSTEEGTSTEPSEGSAPGTSESATPESGPGSE PATSGSETPGTSESATPESGPGSEPATSGSETPGTSESATPESG PGTSTEPSEGSAPGTSESATPESGPGSPAGSPTSTEEGSPAGSP TSTEEGSPAGSPTSTEEGTSESATPESGPGTSTEPSEGSAPGTS ESATPESGPGSEPATSGSETPGTSESATPESGPGSEPATSGSET PGTSESATPESGPGTSTEPSEGSAPGSPAGSPTSTEEGTSESAT PESGPGSEPATSGSETPGTSESATPESGPGSPAGSPTSTEEGSP AGSPTSTEEGTSTEPSEGSAPGTSESATPESGPGTSESATPESG PGTSESATPESGPGSEPATSGSETPGSEPATSGSETPGSPAGSP TSTEEGTSTEPSEGSAPGTSTEPSEGSAPGSEPATS | 628 |
| AE468A | EGSAPGTSTEPSEGSAPGTSTEPSEGSAPGSPAGSPTSTEEGTS TEPSEGSAPGTSESATPESGPGSEPATSGSETPGTSESATPESG PGSEPATSGSETPGTSESATPESGPGTSTEPSEGSAPGTSESAT PESGPGSPAGSPTSTEEGSPAGSPTSTEEGSPAGSPTSTEEGTS ESATPESGPGTSTEPSEGSAPGTSESATPESGPGSEPATSGSET PGTSESATPESGPGSEPATSGSETPGTSESATPESGPGTSTEPS EGSAPGSPAGSPTSTEEGTSESATPESGPGSEPATSGSETPGTS ESATPESGPGSPAGSPTSTEEGSPAGSPTSTEEGTSTEPSEGSA PGTSESATPESGPGTSESATPESGPGTSESATPESGPGSEPATS GSETPGSEPATSGSETPGSPAGSPTSTEEGTSTEPSEGSAPGTS TEPSEGSAPGSEPATSGSETPGTSESAT | 629 |
| AE504A | EGSAPGTSTEPSEGSAPGTSTEPSEGSAPGTSTEPSEGSAPGTS TEPSEGSAPGSPAGSPTSTEEGTSTEPSEGSAPGTSESATPESG PGSEPATSGSETPGTSESATPESGPGSEPATSGSETPGTSESAT PESGPGTSTEPSEGSAPGTSESATPESGPGSPAGSPTSTEEGSP AGSPTSTEEGSPAGSPTSTEEGTSESATPESGPGTSTEPSEGSA PGTSESATPESGPGSEPATSGSETPGTSESATPESGPGSEPATS GSETPGTSESATPESGPGTSTEPSEGSAPGSPAGSPTSTEEGTS ESATPESGPGSEPATSGSETPGTSESATPESGPGSPAGSPTSTE EGSPAGSPTSTEEGTSTEPSEGSAPGTSESATPESGPGTSESAT PESGPGTSESATPESGPGSEPATSGSETPGSEPATSGSETPGSP AGSPTSTEEGTSTEPSEGSAPGTSTEPSEGSAPGSEPATSGSET PGTSESATPESGPGTSTEPS | 630 |
| AE540A | TPESGPGSPAGSPTSTEEGTSESATPESGPGSEPATSGSETPGT SESATPESGPGTSTEPSEGSAPGTSTEPSEGSAPGTSTEPSEGS APGTSTEPSEGSAPGTSTEPSEGSAPGTSTEPSEGSAPGSPAGS PTSTEEGTSTEPSEGSAPGTSESATPESGPGSEPATSGSETPGT SESATPESGPGSEPATSGSETPGTSESATPESGPGTSTEPSEGS APGTSESATPESGPGSPAGSPTSTEEGSPAGSPTSTEEGSPAGS PTSTEEGTSESATPESGPGTSTEPSEGSAPGTSESATPESGPGS EPATSGSETPGTSESATPESGPGSEPATSGSETPGTSESATPES GPGTSTEPSEGSAPGSPAGSPTSTEEGTSESATPESGPGSEPAT SGSETPGTSESATPESGPGSPAGSPTSTEEGSPAGSPTSTEEGT STEPSEGSAPGTSESATPESGPGTSESATPESGPGTSESATPES GPGSEPATSGSETPGSEPATSGSETPGSPAGSPTSTEEGTSTEP SEGSAPGTSTEP | 631 |
| AE576A | TPESGPGTSESATPESGPGSPAGSPTSTEEGTSESATPESGPGS EPATSGSETPGTSESATPESGPGTSTEPSEGSAPGTSTEPSEGS APGTSTEPSEGSAPGTSTEPSEGSAPGTSTEPSEGSAPGTSTEP SEGSAPGSPAGSPTSTEEGTSTEPSEGSAPGTSESATPESGPGS EPATSGSETPGTSESATPESGPGSEPATSGSETPGTSESATPES GPGTSTEPSEGSAPGTSESATPESGPGSPAGSPTSTEEGSPAGS PTSTEEGSPAGSPTSTEEGTSESATPESGPGTSTEPSEGSAPGT SESATPESGPGSEPATSGSETPGTSESATPESGPGSEPATSGSE TPGTSESATPESGPGTSTEPSEGSAPGSPAGSPTSTEEGTSESA TPESGPGSEPATSGSETPGTSESATPESGPGSPAGSPTSTEEGS PAGSPTSTEEGTSTEPSEGSAPGTSESATPESGPGTSESATPES | 632 |

TABLE 3b-continued

Exemplary Existing ELNNs for Engineering into Barcoded ELNN(s)

| ELNN Name | Amino Acid Sequence | SEQ ID NO: |
|---|---|---|
| | GPGTSESATPESGPGSEPATSGSETPGSEPATSGSETPGSPAGS PTSTEEGTSTEPSEGSAPGTSTEPSEGSAPGSEPATSGSETPGT SESA | |
| AE612A | GSETPGTSTEPSEGSAPGTSTEPSEGSAPGTSESATPESGPGTS ESATPESGPGSPAGSPTSTEEGTSESATPESGPGSEPATSGSET PGTSESATPESGPGSTEPSEGSAPGTSTEPSEGSAPGTSTEPS EGSAPGTSTEPSEGSAPGTSTEPSEGSAPGTSTEPSEGSAPGSP AGSPTSTEEGTSTEPSEGSAPGTSESATPESGPGSEPATSGSET PGTSESATPESGPGSEPATSGSETPGTSESATPESGPGTSTEPS EGSAPGTSESATPESGPGSPAGSPTSTEEGSPAGSPTSTEEGSP AGSPTSTEEGTSESATPESGPGTSTEPSEGSAPGTSESATPESG PGSEPATSGSETPGTSESATPESGPGSEPATSGSETPGTSESAT PESGPGTSTEPSEGSAPGSPAGSPTSTEEGTSESATPESGPGSE PATSGSETPGTSESATPESGPGSPAGSPTSTEEGSPAGSPTSTE EGTSTEPSEGSAPGTSESATPESGPGTSESATPESGPGTSESAT PESGPGSEPATSGSETPGSEPATSGSETPGSPAGSPTSTEEGTS TEPSEGSAPGTSTEPSEGSAPGSEPATSGSETPGTSESAT | 633 |
| AE648A | PESGPGTSTEPSEGSAPGTSESATPESGPGSEPATSGSETPGTS TEPSEGSAPGTSTEPSEGSAPGTSESATPESGPGTSESATPESG PGSPAGSPTSTEEGTSESATPESGPGSEPATSGSETPGTSESAT PESGPGTSTEPSEGSAPGTSTEPSEGSAPGTSTEPSEGSAPGTS TEPSEGSAPGTSTEPSEGSAPGTSTEPSEGSAPGSPAGSPTSTE EGTSTEPSEGSAPGTSESATPESGPGSEPATSGSETPGTSESAT PESGPGSEPATSGSETPGTSESATPESGPGTSTEPSEGSAPGTS ESATPESGPGSPAGSPTSTEEGSPAGSPTSTEEGSPAGSPTSTE EGTSESATPESGPGTSTEPSEGSAPGTSESATPESGPGSEPATS GSETPGTSESATPESGPGSEPATSGSETPGTSESATPESGPGTS TEPSEGSAPGSPAGSPTSTEEGTSESATPESGPGSEPATSGSET PGTSESATPESGPGSPAGSPTSTEEGSPAGSPTSTEEGTSTEPS EGSAPGTSESATPESGPGTSESATPESGPGTSESATPESGPGSE PATSGSETPGSEPATSGSETPGSPAGSPTSTEEGTSTEPSEGSA PGTSTEPSEGSAPGSEPATSGSETPGTSESAT | 634 |
| AE684A | EGSAPGSPAGSPTSTEEGTSTEPSEGSAPGTSTEPSEGSAPGTS ESATPESGPGTSTEPSEGSAPGTSESATPESGPGSEPATSGSET PGTSTEPSEGSAPGTSTEPSEGSAPGTSESATPESGPGTSESAT PESGPGSPAGSPTSTEEGTSESATPESGPGSEPATSGSETPGTS ESATPESGPGTSTEPSEGSAPGTSTEPSEGSAPGTSTEPSEGSA PGTSTEPSEGSAPGTSTEPSEGSAPGTSTEPSEGSAPGSPAGSP TSTEEGTSTEPSEGSAPGTSESATPESGPGSEPATSGSETPGTS ESATPESGPGSEPATSGSETPGTSESATPESGPGTSTEPSEGSA PGTSESATPESGPGSPAGSPTSTEEGSPAGSPTSTEEGSPAGSP TSTEEGTSESATPESGPGTSTEPSEGSAPGTSESATPESGPGSE PATSGSETPGTSESATPESGPGSEPATSGSETPGTSESATPESG PGTSTEPSEGSAPGSPAGSPTSTEEGTSESATPESGPGSEPATS GSETPGTSESATPESGPGSPAGSPTSTEEGSPAGSPTSTEEGTS TEPSEGSAPGTSESATPESGPGTSESATPESGPGTSESATPESG PGSEPATSGSETPGSEPATSGSETPGSPAGSPTSTEEGTSTEPS EGSAPGTSTEPSEGSAPGSEPATS | 635 |
| AE720A | TSGSETPGSEPATSGSETPGSPAGSPTSTEEGTSESATPESGPG TSTEPSEGSAPGTSTEPSEGSAPGSPAGSPTSTEEGTSTEPSEG SAPGTSTEPSEGSAPGTSESATPESGPGTSTEPSEGSAPGTSES ATPESGPGSEPATSGSETPGTSTEPSEGSAPGTSTEPSEGSAPG TSESATPESGPGTSESATPESGPGSPAGSPTSTEEGTSESATPE SGPGSEPATSGSETPGTSESATPESGPGTSTEPSEGSAPGTSTE PSEGSAPGTSTEPSEGSAPGTSTEPSEGSAPGTSTEPSEGSAPG TSTEPSEGSAPGSPAGSPTSTEEGTSTEPSEGSAPGTSESATPE SGPGSEPATSGSETPGTSESATPESGPGSEPATSGSETPGTSES ATPESGPGTSTEPSEGSAPGTSESATPESGPGSPAGSPTSTEEG SPAGSPTSTEEGSPAGSPTSTEEGTSESATPESGPGTSTEPSEG SAPGTSESATPESGPGSEPATSGSETPGTSESATPESGPGSEPA TSGSETPGTSESATPESGPGTSTEPSEGSAPGSPAGSPTSTEEG TSESATPESGPGSEPATSGSETPGTSESATPESGPGSPAGSPTS TEEGSPAGSPTSTEEGTSTEPSEGSAPGTSESATPESGPGTSES ATPESGPGTSESATPESGPGSEPATSGSETPGSEPATSGSETPG SPAGSPTSTEEGTSTE | 636 |
| AE756A | TSGSETPGSEPATSGSETPGSPAGSPTSTEEGTSESATPESGPG TSTEPSEGSAPGTSTEPSEGSAPGSPAGSPTSTEEGTSTEPSEG SAPGTSTEPSEGSAPGTSESATPESGPGTSTEPSEGSAPGTSES ATPESGPGSEPATSGSETPGTSTEPSEGSAPGTSTEPSEGSAPG TSESATPESGPGTSESATPESGPGSPAGSPTSTEEGTSESATPE | 637 |

TABLE 3b-continued

Exemplary Existing ELNNs for Engineering into Barcoded ELNN(s)

| ELNN Name | Amino Acid Sequence | SEQ ID NO: |
|---|---|---|
| | SGPGSEPATSGSETPGTSESATPESGPGTSTEPSEGSAPGTSTE PSEGSAPGTSTEPSEGSAPGTSTEPSEGSAPGTSTEPSEGSAPG TSTEPSEGSAPGSPAGSPTSTEEGTSTEPSEGSAPGTSESATPE SGPGSEPATSGSETPGTSESATPESGPGSEPATSGSETPGTSES ATPESGPGTSTEPSEGSAPGTSESATPESGPGSPAGSPTSTEEG SPAGSPTSTEEGSPAGSPTSTEEGTSESATPESGPGTSTEPSEG SAPGTSESATPESGPGSEPATSGSETPGTSESATPESGPGSEPA TSGSETPGTSESATPESGPGSAPGTSTEPSEGSAPGSPAGSPTSTEEG TSESATPESGPGSEPATSGSETPGTSESATPESGPGSPAGSPTS TEEGSPAGSPTSTEEGTSTEPSEGSAPGTSESATPESGPGTSES ATPESGPGTSESATPESGPGSEPATSGSETPGSEPATSGSETPG SPAGSPTSTEEGTSTEPSEGSAPGTSTEPSEGSAPGSEPATSGS ETPGTSES | |
| AE792A | EGSAPGTSESATPESGPGSEPATSGSETPGSEPATSGSETPGSP AGSPTSTEEGTSESATPESGPGTSTEPSEGSAPGTSTEPSEGSA PGSPAGSPTSTEEGTSTEPSEGSAPGTSTEPSEGSAPGTSESAT PESGPGTSTEPSEGSAPGTSESATPESGPGSEPATSGSETPGTS TEPSEGSAPGTSTEPSEGSAPGTSESATPESGPGTSESATPESG PGSPAGSPTSTEEGTSESATPESGPGSEPATSGSETPGTSESAT PESGPGTSTEPSEGSAPGTSTEPSEGSAPGTSTEPSEGSAPGTS TEPSEGSAPGTSTEPSEGSAPGTSTEPSEGSAPGSPAGSPTSTE EGTSTEPSEGSAPGTSESATPESGPGSEPATSGSETPGTSESAT PESGPGSEPATSGSETPGTSESATPESGPGTSTEPSEGSAPGTS ESATPESGPGSPAGSPTSTEEGSPAGSPTSTEEGSPAGSPTSTE EGTSESATPESGPGTSTEPSEGSAPGTSESATPESGPGSEPATS GSETPGTSESATPESGPGSEPATSGSETPGTSESATPESGPGTS TEPSEGSAPGSPAGSPTSTEEGTSESATPESGPGSEPATSGSET PGTSESATPESGPGSPAGSPTSTEEGSPAGSPTSTEEGTSTEPS EGSAPGTSESATPESGPGTSESATPESGPGTSESATPESGPGSE PATSGSETPGSEPATSGSETPGSPAGSPTSTEEGTSTEPSEGSA PGTSTEPSEGSAPGSEPATSGSETPGTSESATPESGPGTSTEPS | 638 |
| AE828A | PESGPGTSTEPSEGSAPGSPAGSPTSTEEGTSTEPSEGSAPGTS TEPSEGSAPGTSESATPESGPGSEPATSGSETPGSEPATSGSET PGSPAGSPTSTEEGTSESATPESGPGTSTEPSEGSAPGTSTEPS EGSAPGSPAGSPTSTEEGTSTEPSEGSAPGTSTEPSEGSAPGTS ESATPESGPGTSTEPSEGSAPGTSESATPESGPGSEPATSGSET PGTSTEPSEGSAPGTSTEPSEGSAPGTSESATPESGPGTSESAT PESGPGSPAGSPTSTEEGTSESATPESGPGSEPATSGSETPGTS ESATPESGPGTSTEPSEGSAPGTSTEPSEGSAPGTSTEPSEGSA PGTSTEPSEGSAPGTSTEPSEGSAPGTSTEPSEGSAPGSPAGSP TSTEEGTSTEPSEGSAPGTSESATPESGPGSEPATSGSETPGTS ESATPESGPGSEPATSGSETPGTSESATPESGPGTSTEPSEGSA PGTSESATPESGPGSPAGSPTSTEEGSPAGSPTSTEEGSPAGSP TSTEEGTSESATPESGPGTSTEPSEGSAPGTSESATPESGPGSE PATSGSETPGTSESATPESGPGSEPATSGSETPGTSESATPESG PGTSTEPSEGSAPGSPAGSPTSTEEGTSESATPESGPGSEPATS GSETPGTSESATPESGPGSPAGSPTSTEEGSPAGSPTSTEEGTS TEPSEGSAPGTSESATPESGPGTSESATPESGPGTSESATPESG PGSEPATSGSETPGSEPATSGSETPGSPAGSPTSTEEGTSTEPS EGSAPGTSTEPSEGSAPGSEPATSGSETPGTSESAT | 639 |
| AE869 | GSPGSPAGSPTSTEEGTSESATPESGPGTSTEPSEGSAPGSPAG SPTSTEEGTSTEPSEGSAPGTSTEPSEGSAPGTSESATPESGPG SEPATSGSETPGSEPATSGSETPGSPAGSPTSTEEGTSESATPE SGPGTSTEPSEGSAPGTSTEPSEGSAPGSPAGSPTSTEEGTSTE PSEGSAPGTSTEPSEGSAPGTSESATPESGPGTSTEPSEGSAPG TSESATPESGPGSEPATSGSETPGTSTEPSEGSAPGTSTEPSEG SAPGTSESATPESGPGTSESATPESGPGSPAGSPTSTEEGTSES ATPESGPGSEPATSGSETPGTSESATPESGPGTSTEPSEGSAPG TSTEPSEGSAPGTSTEPSEGSAPGTSTEPSEGSAPGTSTEPSEG SAPGTSTEPSEGSAPGSPAGSPTSTEEGTSTEPSEGSAPGTSES ATPESGPGSEPATSGSETPGTSESATPESGPGSEPATSGSETPG TSESATPESGPGTSTEPSEGSAPGTSESATPESGPGSPAGSPTS TEEGSPAGSPTSTEEGSPAGSPTSTEEGTSESATPESGPGTSTE PSEGSAPGTSESATPESGPGSEPATSGSETPGTSESATPESGPG SEPATSGSETPGTSESATPESGPGTSTEPSEGSAPGSPAGSPTS TEEGTSESATPESGPGSEPATSGSETPGTSESATPESGPGSPAG SPTSTEEGSPAGSPTSTEEGTSTEPSEGSAPGTSESATPESGPG TSESATPESGPGTSESATPESGPGSEPATSGSETPGSEPATSGS ETPGSPAGSPTSTEEGTSTEPSEGSAPGTSTEPSEGSAPGSEPA TSGSETPGTSESATPESGPGTSTEPSEGSAPGR | 640 |

TABLE 3b-continued

Exemplary Existing ELNNs for Engineering into Barcoded ELNN(s)

| ELNN Name | Amino Acid Sequence | SEQ ID NO: |
|---|---|---|
| AE144_R1 | SAGSPGSPAGSPTSTEEGTSESATPESGPGTSTEPSEGSAPGSP AGSPTSTEEGTSTEPSEGSAPGTSTEPSEGSAPGTSESATPESG PGSEPATSGSETPGSEPATSGSETPGSPAGSPTSTEEGTSESAT PESGPGTESASR | 641 |
| AE288_R1 | SAGSPTGPGSEPATSGSETPGTSESATPESGPGSEPATSGSETP GTSESATPESGPGTSTEPSEGSAPGSPAGSPTSTEEGTSESATP ESGPGSEPATSGSETPGTSESATPESGPGSPAGSPTSTEEGSPA GSPTSTEEGTSTEPSEGSAPGTSESATPESGPGTSESATPESGP GTSESATPESGPGSEPATSGSETPGSEPATSGSETPGSPAGSPT STEEGTSTEPSEGSAPGTSTEPSEGSAPGSEPATSGSETPGTSE SATPESGPGTSTEPSEGSAPSASR | 642 |
| AE432_R1 | SAGSPGSPAGSPTSTEEGTSESATPESGPGTSTEPSEGSAPGSP AGSPTSTEEGTSTEPSEGSAPGTSTEPSEGSAPGTSESATPESG PGSEPATSGSETPGSEPATSGSETPGSPAGSPTSTEEGTSESAT PESGPGTSTEPSEGSAPGTSTEPSEGSAPGSPAGSPTSTEEGTS TEPSEGSAPGTSTEPSEGSAPGTSESATPESGPGTSTEPSEGSA PGTSESATPESGPGSEPATSGSETPGTSTEPSEGSAPGTSTEPS EGSAPGTSESATPESGPGTSESATPESGPGSPAGSPTSTEEGTS ESATPESGPGSEPATSGSETPGTSESATPESGPGTSTEPSEGSA PGTSTEPSEGSAPGTSTEPSEGSAPGTSTEPSEGSAPGTSTEPS EGSAPGTSTEPSEGSAPGSPAGSPTSTEEGTESASR | 643 |
| AE576_R1 | SAGSPTEEGTSESATPESGPGSEPATSGSETPGTSESATPESGP GTSTEPSEGSAPGTSTEPSEGSAPGTSTEPSEGSAPGTSTEPSE GSAPGTSTEPSEGSAPGTSTEPSEGSAPGSPAGSPTSTEEGTST EPSEGSAPGTSESATPESGPGSEPATSGSETPGTSESATPESGP GSEPATSGSETPGTSESATPESGPGTSTEPSEGSAPGTSESATP ESGPGSPAGSPTSTEEGSPAGSPTSTEEGSPAGSPTSTEEGTSE SATPESGPGTSTEPSEGSAPGTSESATPESGPGSEPATSGSETP GTSESATPESGPGSEPATSGSETPGTSESATPESGPGTSTEPSE GSAPGSPAGSPTSTEEGTSESATPESGPGSEPATSGSETPGTSE SATPESGPGSPAGSPTSTEEGSPAGSPTSTEEGTSTEPSEGSAP GTSESATPESGPGTSESATPESGPGTSESATPESGPGSEPATSG SETPGSEPATSGSETPGSPAGSPTSTEEGTSTEPSEGSAPGTST EPSEGSAPGSEPATSGSETPGTSESATPESGPGTSTEPSEGSAP SASR | 644 |
| AE864_R1 | SAGSPGSPAGSPTSTEEGTSESATPESGPGTSTEPSEGSAPGSP AGSPTSTEEGTSTEPSEGSAPGTSTEPSEGSAPGTSESATPESG PGSEPATSGSETPGSEPATSGSETPGSPAGSPTSTEEGTSESAT PESGPGTSTEPSEGSAPGTSTEPSEGSAPGSPAGSPTSTEEGTS TEPSEGSAPGTSTEPSEGSAPGTSESATPESGPGTSTEPSEGSA PGTSESATPESGPGSEPATSGSETPGTSTEPSEGSAPGTSTEPS EGSAPGTSESATPESGPGTSESATPESGPGSPAGSPTSTEEGTS ESATPESGPGSEPATSGSETPGTSESATPESGPGTSTEPSEGSA PGTSTEPSEGSAPGTSTEPSEGSAPGTSTEPSEGSAPGTSTEPS EGSAPGTSTEPSEGSAPGSPAGSPTSTEEGTSTEPSEGSAPGTS ESATPESGPGSEPATSGSETPGTSESATPESGPGSEPATSGSET PGTSESATPESGPGTSTEPSEGSAPGTSESATPESGPGSPAGSP TSTEEGSPAGSPTSTEEGSPAGSPTSTEEGTSESATPESGPGTS TEPSEGSAPGTSESATPESGPGSEPATSGSETPGTSESATPESG PGSEPATSGSETPGTSESATPESGPGTSTEPSEGSAPGSPAGSP TSTEEGTSESATPESGPGSEPATSGSETPGTSESATPESGPGSP AGSPTSTEEGSPAGSPTSTEEGTSTEPSEGSAPGTSESATPESG PGTSESATPESGPGTSESATPESGPGSEPATSGSETPGSEPATS GSETPGSPAGSPTSTEEGTSTEPSEGSAPGTSTEPSEGSAPGSE PATSGSETPGTSESATPESGPGTESASR | 645 |
| AE712 | PGSPAGSPTSTEEGTSESATPESGPGTSTEPSEGSAPGSPAGSP TSTEEGTSTEPSEGSAPGTSTEPSEGSAPGTSESATPESGPGSE PATSGSETPGSEPATSGSETPGSPAGSPTSTEEGTSESATPESG PGTSTEPSEGSAPGTSTEPSEGSAPGSPAGSPTSTEEGTSTEPS EGSAPGTSTEPSEGSAPGTSESATPESGPGTSTEPSEGSAPGTS ESATPESGPGSEPATSGSETPGTSTEPSEGSAPGTSTEPSEGSA PGTSESATPESGPGTSESATPESGPGSPAGSPTSTEEGTSESAT PESGPGSEPATSGSETPGTSESATPESGPGTSTEPSEGSAPGTS TEPSEGSAPGTSTEPSEGSAPGTSTEPSEGSAPGTSTEPSEGSA PGTSTEPSEGSAPGSPAGSPTSTEEGTSTEPSEGSAPGTSESAT PESGPGSEPATSGSETPGTSESATPESGPGSEPATSGSETPGTS ESATPESGPGTSTEPSEGSAPGTSESATPESGPGSPAGSPTSTE | 646 |

TABLE 3b-continued

Exemplary Existing ELNNs for Engineering into Barcoded ELNN(s)

| ELNN Name | Amino Acid Sequence | SEQ ID NO: |
|---|---|---|
| | EGSPAGSPTSTEEGSPAGSPTSTEEGTSESATPESGPGTSTEPS EGSAPGTSESATPESGPGSEPATSGSETPGTSESATPESGPGSE PATSGSETPGTSESATPESGPGTSTEPSEGSAPGSPAGSPTSTE EGTSESATPESGPGSEPATSGSETPGTSESATPESGPGSPAGSP TSTEAHHH | |
| AE864_R2 | GSPGAGSPAGSPTSTEEGTSESATPESGPGTSTEPSEGSAPGSP AGSPTSTEEGTSTEPSEGSAPGTSTEPSEGSAPGTSESATPESG PGSEPATSGSETPGSEPATSGSETPGSPAGSPTSTEEGTSESAT PESGPGTSTEPSEGSAPGTSTEPSEGSAPGSPAGSPTSTEEGTS TEPSEGSAPGTSTEPSEGSAPGTSESATPESGPGTSTEPSEGSA PGTSESATPESGPGSEPATSGSETPGTSTEPSEGSAPGTSTEPS EGSAPGTSESATPESGPGTSESATPESGPGSPAGSPTSTEEGTS ESATPESGPGSEPATSGSETPGTSESATPESGPGTSTEPSEGSA PGTSTEPSEGSAPGTSTEPSEGSAPGTSTEPSEGSAPGTSTEPS EGSAPGTSTEPSEGSAPGSPAGSPTSTEEGTSTEPSEGSAPGTS ESATPESGPGSEPATSGSETPGTSESATPESGPGSEPATSGSET PGTSESATPESGPGTSTEPSEGSAPGTSESATPESGPGSPAGSP TSTEEGSPAGSPTSTEEGSPAGSPTSTEEGTSESATPESGPGTS TEPSEGSAPGTSESATPESGPGSEPATSGSETPGTSESATPESG PGSEPATSGSETPGTSESATPESGPGTSTEPSEGSAPGSPAGSP TSTEEGTSESATPESGPGSEPATSGSETPGTSESATPESGPGSP AGSPTSTEEGSPAGSPTSTEEGTSTEPSEGSAPGTSESATPESG PGTSESATPESGPGTSESATPESGPGSEPATSGSETPGSEPATS GSETPGSPAGSPTSTEEGTSTEPSEGSAPGTSTEPSEGSAPGSE PATSGSETPGTSESATPESGPGTESASR | 647 |
| AE288_3 | SPAGSPTSTEEGTSESATPESGPGTSTEPSEGSAPGTSESATPE SGPGSEPATSGSETPGTSESATPESGPGSEPATSGSETPGTSES ATPESGPGTSTEPSEGSAPGSPAGSPTSTEEGTSESATPESGPG SEPATSGSETPGTSESATPESGPGSPAGSPTSTEEGSPAGSPTS TEEGTSTEPSEGSAPGTSESATPESGPGTSESATPESGPGTSES ATPESGPGSEPATSGSETPGSEPATSGSETPGSPAGSPTSTEEG TSTEPSEGSAPGTSTEPSEGSAPG | 648 |
| AE284 | GTSESATPESGPGSEPATSGSETPGTSESATPESGPGSEPATSG SETPGTSESATPESGPGTSTEPSEGSAPGSPAGSPTSTEEGTSE SATPESGPGSEPATSGSETPGTSESATPESGPGSPAGSPTSTEE GSPAGSPTSTEEGTSTEPSEGSAPGTSESATPESGPGTSESATP ESGPGTSESATPESGPGSEPATSGSETPGSEPATSGSETPGSPA GSPTSTEEGTSTEPSEGSAPGTSTEPSEGSAPGSEPATSGSETP GTSESATPESGPGTSTEPSE | 649 |
| AE292 | SPAGSPTSTEEGTSESATPESGPGTSTEPSEGSAPGTSESATPE SGPGSEPATSGSETPGTSESATPESGPGSEPATSGSETPGTSES ATPESGPGTSTEPSEGSAPGSPAGSPTSTEEGTSESATPESGPG SEPATSGSETPGTSESATPESGPGSPAGSPTSTEEGSPAGSPTS TEEGTSTEPSEGSAPGTSESATPESGPGTSESATPESGPGTSES ATPESGPGSEPATSGSETPGSEPATSGSETPGSPAGSPTSTEEG TSTEPSEGSAPGTSTEPSEGSAPGGSAP | 650 |
| AE864_2 | AGSPTSTEEGTSESATPESGPGTSTEPSEGSAPGSPAGSPTSTE EGTSTEPSEGSAPGTSTEPSEGSAPGTSESATPESGPGSEPATS GSETPGSEPATSGSETPGSPAGSPTSTEEGTSESATPESGPGTS TEPSEGSAPGTSTEPSEGSAPGSPAGSPTSTEEGTSTEPSEGSA PGTSTEPSEGSAPGTSESATPESGPGTSTEPSEGSAPGTSESAT PESGPGSEPATSGSETPGTSTEPSEGSAPGTSTEPSEGSAPGTS ESATPESGPGTSESATPESGPGSPAGSPTSTEEGTSESATPESG PGSEPATSGSETPGTSESATPESGPGTSTEPSEGSAPGTSTEPS EGSAPGTSTEPSEGSAPGTSTEPSEGSAPGTSTEPSEGSAPGTS TEPSEGSAPGSPAGSPTSTEEGTSTEPSEGSAPGTSESATPESG PGSEPATSGSETPGTSESATPESGPGSEPATSGSETPGTSESAT PESGPGTSTEPSEGSAPGTSESATPESGPGSPAGSPTSTEEGSP AGSPTSTEEGSPAGSPTSTEEGTSESATPESGPGTSTEPSEGSA PGTSESATPESGPGSEPATSGSETPGTSESATPESGPGSEPATS GSETPGTSESATPESGPGTSTEPSEGSAPGSPAGSPTSTEEGTS ESATPESGPGSEPATSGSETPGTSESATPESGPGSPAGSPTSTE EGSPAGSPTSTEEGTSTEPSEGSAPGTSESATPESGPGTSESAT PESGPGTSESATPESGPGSEPATSGSETPGSEPATSGSETPGSP AGSPTSTEEGTSTEPSEGSAPGTSTEPSEGSAPGSEPATSGSET PGTSESATPESGPGTSTEPSEGAAEPEA | 651 |
| AE867 | GSPAGSPTSTEEGTSESATPESGPGTSTEPSEGSAPGSPAGSPT STEEGTSTEPSEGSAPGTSTEPSEGSAPGTSESATPESGPGSEP ATSGSETPGSEPATSGSETPGSPAGSPTSTEEGTSESATPESGP | 652 |

TABLE 3b-continued

Exemplary Existing ELNNs for Engineering into Barcoded ELNN(s)

| ELNN Name | Amino Acid Sequence | SEQ ID NO: |
|---|---|---|
| | GTSTEPSEGSAPGTSTEPSEGSAPGSPAGSPTSTEEGTSTEPSE<br>GSAPGTSTEPSEGSAPGTSESATPESGPGTSTEPSEGSAPGTSE<br>SATPESGPGSEPATSGSETPGTSTEPSEGSAPGTSTEPSEGSAP<br>GTSESATPESGPGTSESATPESGPGSPAGSPTSTEEGTSESATP<br>ESGPGSEPATSGSETPGTSESATPESGPGTSTEPSEGSAPGTST<br>EPSEGSAPGTSTEPSEGSAPGTSTEPSEGSAPGTSTEPSEGSAP<br>GTSTEPSEGSAPGSPAGSPTSTEEGTSTEPSEGSAPGTSESATP<br>ESGPGSEPATSGSETPGTSESATPESGPGSEPATSGSETPGTSE<br>SATPESGPGTSTEPSEGSAPGTSESATPESGPGSPAGSPTSTEE<br>GSPAGSPTSTEEGSPAGSPTSTEEGTSESATPESGPGTSTEPSE<br>GSAPGTSESATPESGPGSEPATSGSETPGTSESATPESGPGSEP<br>ATSGSETPGTSESATPESGPGTSTEPSEGSAPGSPAGSPTSTEE<br>GTSESATPESGPGSEPATSGSETPGTSESATPESGPGSPAGSPT<br>STEEGSPAGSPTSTEEGTSTEPSEGSAPGTSESATPESGPGTSE<br>SATPESGPGTSESATPESGPGSEPATSGSETPGSEPATSGSETP<br>GSPAGSPTSTEEGTSTEPSEGSAPGTSTEPSEGSAPGSEPATSG<br>SETPGTSESATPESGPGTSTEPSEGAAEPEA | |
| AE867_2 | SPGSPAGSPTSTEEGTSESATPESGPGTSTEPSEGSAPGSPAGS<br>PTSTEEGTSTEPSEGSAPGTSTEPSEGSAPGTSESATPESGPGS<br>EPATSGSETPGSEPATSGSETPGSPAGSPTSTEEGTSESATPES<br>GPGTSTEPSEGSAPGTSTEPSEGSAPGSPAGSPTSTEEGTSTEP<br>SEGSAPGTSTEPSEGSAPGTSESATPESGPGTSTEPSEGSAPGT<br>SESATPESGPGSEPATSGSETPGTSTEPSEGSAPGTSTEPSEGS<br>APGTSESATPESGPGTSESATPESGPGSPAGSPTSTEEGTSESA<br>TPESGPGSEPATSGSETPGTSESATPESGPGTSTEPSEGSAPGT<br>STEPSEGSAPGTSTEPSEGSAPGTSTEPSEGSAPGTSTEPSEGS<br>APGTSTEPSEGSAPGSPAGSPTSTEEGTSTEPSEGSAPGTSESA<br>TPESGPGSEPATSGSETPGTSESATPESGPGSEPATSGSETPGT<br>SESATPESGPGTSTEPSEGSAPGTSESATPESGPGSPAGSPTST<br>EEGSPAGSPTSTEEGSPAGSPTSTEEGTSESATPESGPGTSTEP<br>SEGSAPGTSESATPESGPGSEPATSGSETPGTSESATPESGPGS<br>EPATSGSETPGTSESATPESGPGTSTEPSEGSAPGSPAGSPTST<br>EEGTSESATPESGPGSEPATSGSETPGTSESATPESGPGSPAGS<br>PTSTEEGSPAGSPTSTEEGTSTEPSEGSAPGTSESATPESGPGT<br>SESATPESGPGTSESATPESGPGSEPATSGSETPGSEPATSGSE<br>TPGSPAGSPTSTEEGTSTEPSEGSAPGTSTEPSEGSAPGSEPAT<br>SGSETPGTSESATPESGPGTSTEPSEGSAPG | 653 |
| AE868 | PGSPAGSPTSTEEGTSESATPESGPGTSTEPSEGSAPGSPAGSP<br>TSTEEGTSTEPSEGSAPGTSTEPSEGSAPGTSESATPESGPGSE<br>PATSGSETPGSEPATSGSETPGSPAGSPTSTEEGTSESATPESG<br>PGTSTEPSEGSAPGTSTEPSEGSAPGSPAGSPTSTEEGTSTEPS<br>EGSAPGTSTEPSEGSAPGTSESATPESGPGTSTEPSEGSAPGTS<br>ESATPESGPGSEPATSGSETPGTSTEPSEGSAPGTSTEPSEGSA<br>PGTSESATPESGPGTSESATPESGPGSPAGSPTSTEEGTSESAT<br>PESGPGSEPATSGSETPGTSESATPESGPGTSTEPSEGSAPGTS<br>TEPSEGSAPGTSTEPSEGSAPGTSTEPSEGSAPGTSTEPSEGSA<br>PGTSTEPSEGSAPGSPAGSPTSTEEGTSTEPSEGSAPGTSESAT<br>PESGPGSEPATSGSETPGTSESATPESGPGSEPATSGSETPGTS<br>ESATPESGPGTSTEPSEGSAPGTSESATPESGPGSPAGSPTSTE<br>EGSPAGSPTSTEEGSPAGSPTSTEEGTSESATPESGPGTSTEPS<br>EGSAPGTSESATPESGPGSEPATSGSETPGTSESATPESGPGSE<br>PATSGSETPGTSESATPESGPGTSTEPSEGSAPGSPAGSPTSTE<br>EGTSESATPESGPGSEPATSGSETPGTSESATPESGPGSPAGSP<br>TSTEEGSPAGSPTSTEEGTSTEPSEGSAPGTSESATPESGPGTS<br>ESATPESGPGTSESATPESGPGSEPATSGSETPGSEPATSGSET<br>PGSPAGSPTSTEEGTSTEPSEGSAPGTSTEPSEGSAPGSEPATS<br>GSETPGTSESATPESGPGTSTEPSEGAAEPEA | 654 |
| AE144_7A | GSPAGSPTSTEEGTSESATPESGPGTSTEPSEGSAPGSPAGSPT<br>STEEGTSTEPSEGSAPGTSTEPSEGSAPGTSESATPESGPGSEP<br>ATSGSETPGSEPATSGSETPGSPAGSPTSTEEGTSESATPESGP<br>GTSTEPSEGSAP | 655 |
| AE292 | SPAGSPTSTEEGTSESATPESGPGTSTEPSEGSAPGTSESATPE<br>SGPGSEPATSGSETPGTSESATPESGPGSEPATSGSETPGTSES<br>ATPESGPGTSTEPSEGSAPGSPAGSPTSTEEGTSESATPESGPG<br>SEPATSGSETPGTSESATPESGPGSPAGSPTSTEEGSPAGSPTS<br>TEEGTSTEPSEGSAPGTSTEPSEGSAPGTSTEPSEGSAPGTSES<br>ATPESGPGSEPATSGSETPGSEPATSGSETPGSPAGSPTSTEEG<br>TSTEPSEGSAPGTSTEPSEGSAPGGSAP | 656 |
| AE293 | PGSPAGSPTSTEEGTSESATPESGPGTSTEPSEGSAPGSPAGSP<br>TSTEEGTSTEPSEGSAPGTSTEPSEGSAPGTSESATPESGPGSE | 657 |

TABLE 3b-continued

Exemplary Existing ELNNs for Engineering into Barcoded ELNN(s)

| ELNN Name | Amino Acid Sequence | SEQ ID NO: |
|---|---|---|
| | PATSGSETPGSEPATSGSETPGSPAGSPTSTEEGTSESATPESG PGTSTEPSEGSAPGTSTEPSEGSAPGSPAGSPTSTEEGTSTEPS EGSAPGTSTEPSEGSAPGTSESATPESGPGTSTEPSEGSAPGTS ESATPESGPGSEPATSGSETPGTSTEPSEGSAPGTSTEPSEGSA PGTSESATPESGPGTSESATPEGAAEPEA | |
| AE300 | PGSPAGSPTSTEEGTSESATPESGPGTSTEPSEGSAPGSPAGSP TSTEEGTSTEPSEGSAPGTSTEPSEGSAPGTSESATPESGPGSE PATSGSETPGSEPATSGSETPGSPAGSPTSTEEGTSESATPESG PGTSTEPSEGSAPGTSTEPSEGSAPGSPAGSPTSTEEGTSTEPS EGSAPGTSTEPSEGSAPGTSESATPESGPGTSTEPSEGSAPGTS ESATPESGPGSEPATSGSETPGTSTEPSEGSAPGTSTEPSEGSA PGTSESATPESGPGTSESATPESGPGSPAGAAEPEA | 658 |
| AE584 | PGSPAGSPTSTEEGTSESATPESGPGTSTEPSEGSAPGSPAGSP TSTEEGTSTEPSEGSAPGTSTEPSEGSAPGTSESATPESGPGSE PATSGSETPGSEPATSGSETPGSPAGSPTSTEEGTSESATPESG PGTSTEPSEGSAPGTSTEPSEGSAPGSPAGSPTSTEEGTSTEPS EGSAPGTSTEPSEGSAPGTSESATPESGPGTSTEPSEGSAPGTS ESATPESGPGSEPATSGSETPGTSTEPSEGSAPGTSTEPSEGSA PGTSESATPESGPGTSESATPESGPGSPAGSPTSTEEGTSESAT PESGPGSEPATSGSETPGTSESATPESGPGTSTEPSEGSAPGTS TEPSEGSAPGTSTEPSEGSAPGTSTEPSEGSAPGTSTEPSEGSA PGTSTEPSEGSAPGSPAGSPTSTEEGTSTEPSEGSAPGTSESAT PESGPGSEPATSGSETPGTSESATPESGPGSEPATSGSETPGTS ESATPESGPGTSTEPSEGSAPGTSESATPESGPGSPAGSPTSTE EGSPAGSPTSTEEGSPAGSPTSTEEGTSESATPESGPGTSTEPS EGSAPGAAEPEA | 659 |

In some embodiments, for constructing the sequence of a barcoded ELNN, amino-acid mutations are performed on ELNN of intermediate lengths to those of Table 3b, as well as ELNN of longer lengths than those of Table 3b, such as those in which one or more 12-mer motifs of Table 1 are added to the N- or C-terminus of a general-purpose ELNN of Table 3b.

Additional examples of existing ELNNs that can be used according to the present disclosure are disclosed in U.S. Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891; each of which is herein incorporated by reference.

In some embodiments, a barcoded ELNN fused within a polypeptide chain adjacent to the N-terminus of the polypeptide chain ("N-terminal ELNN") can be attached to a His tag of HHHHHH (SEQ ID NO: 48) or HHHHHHHH (SEQ ID NO: 49) at the N-terminus to facilitate the purification of the fusion polypeptide. In some embodiments, a barcoded ELNN fused within a polypeptide chain at the C-terminus of the polypeptide chain ("C-terminal ELNN") can be comprise or be attached to the sequence EPEA at the C-terminus to facilitate the purification of the fusion polypeptide. In some embodiments, the fusion polypeptide comprises both an N-terminal barcoded ELNN and a C-terminal barcoded ELNN, wherein the N-terminal barcoded ELNN is attached to a His tag of HHHHHH (SEQ ID NO: 48) or HHHHHHHH (SEQ ID NO: 49) at the N-terminus; and wherein the C-terminal barcoded ELNN is attached to the sequence EPEA at the C-terminus, thereby facilitating purification of the fusion polypeptide, for example, to at least 85%, 90%, 91%, 92%, 93%, 94%, 95%, 96%, 97%, 98%, or at least 99% purity by chromatography methods known in the art, including but not limited to IMAC chromatography, C-tagXL affinity matrix, and other such methods.

A barcode fragment, as described herein, can be cleavably fused within the ELNN and releasable (i.e., configured to be released) from the ELNN upon digestion of the polypeptide by a protease. In some embodiments, the protease is a Glu-C protease. In some embodiments, the protease cleaves on the C-terminal side of glutamic acid residues that are not followed by proline. In some embodiments, a barcoded ELNN (an ELNN that contains barcode fragment(s) therewithin) is designed to achieve high efficiency, precision and accuracy of the protease digestion. For example, in some embodiments, adjacent Glu-Glu (EE) residues in an ELNN sequence can result in varying cleavage patterns upon Glu-C digestion. Accordingly, when Glu-C protease is used for barcode release, the barcoded ELNN or the barcode fragment(s) may not contain any Glu-Glu (EE) sequence. Additionally, a di-peptide Glu-Pro (EP) sequence, if present in the fusion polypeptide, may not be cleaved by Glu-C protease during the barcode release process.

Structural Configuration of Activatable TCEs

In some embodiments, a fusion protein comprises a single BsAb in the form of a TCE and a single ELNN. In some embodiments, such a fusion protein can have at least the following permutations of configurations, each listed in an N- to C-terminus orientation: (TCE)-(ELNN); (ELNN)-(TCE); (TCE)-(Linker)-(ELNN); and (ELNN)-(Linker)-(TCE).

In some embodiments, the fusion protein comprises a C-terminal ELNN and, optionally, a linker (such as one described herein, e.g., in Table C) between the ELNN and the TCE. In some embodiments, such a fusion protein can be represented by Formula I (depicted N- to C-terminus):

(TCE)-(Linker)-(ELNN)     (I), wherein the TCE is as described herein; Linker is a linker sequence (such as one described herein, e.g., in Table C) comprising between 1 to about 50 amino acid residues that can optionally include a TCE release segment (e.g., as described herein); and the ELNN can be any ELNN described herein.

In some embodiments, the fusion protein comprises an N-terminal ELNN and, optionally, a linker (such as one described herein, e.g., in Table C) between the ELNN and the TCE. In some embodiments, such a fusion protein can be represented by Formula II (depicted N- to C-terminus):

(ELNN)-(Linker)-(TCE)   (II), wherein TCE is as described herein; Linker is a linker sequence (such as one described herein, e.g., in Table C) comprising between 1 to about 50 amino acid residues that can optionally include a TCE release segment (e.g., as described herein); and ELNN can be any ELNN described herein.

In some embodiments, the fusion protein comprises both an N-terminal ELNN and a C-terminal ELNN. In some embodiments, such a fusion protein can be represented by Formula III:

(ELNN)-(Linker)-(TCE)-(Linker)-(ELNN)   (III)

wherein TCE is as described herein; each Linker is, individually, a linker sequence (such as one described herein, e.g., in Table C) having between 1 to about 50 amino acid residues that can optionally include a TCE release segment (e.g., as described herein); and each ELNN can be, individually, any ELNN described herein.

The present disclosure provides BsAbs (e.g., TCEs) comprise one or more sequences disclosed herein in any one of Tables 6a-6g.

Of particular interest are BsAbs (e.g., TCEs) for which an increase in a pharmacokinetic parameter, increased solubility, increased stability, masking of activity, or some other enhanced pharmaceutical property is sought, or those BsAbs (e.g., TCEs) for which increasing the terminal half-life would improve efficacy, and/or safety. Thus, the paTCE fusion protein compositions are prepared with various objectives in mind, including improving the therapeutic efficacy of the TCE by, for example, increasing the in vivo exposure or the length that the TCE remains within the therapeutic window when administered to a subject, compared to a TCE not linked to any ELNNs.

It will be appreciated that various amino acid substitutions (especially conservative amino acid substitutions) can be made in a bispecific sequence to create variants without departing from the spirit of the present disclosure with respect to the biological activity or pharmacologic properties of, e.g., a TCE. Examples of conservative substitutions for amino acids in polypeptide sequences are shown in Table 4. In addition, variants can also include, for instance, polypeptides wherein one or more amino acid residues are added or deleted at the N- or C-terminus of the full-length native amino acid sequence of a TCE that retains at least a portion of the biological activity of the native peptide.

In some embodiments, sequences that retain at least about 40%, or about 50%, or about 55%, or about 60%, or about 70%, or about 80%, or about 90%, or about 95% or more of the activity compared to the corresponding original TCE sequence would be considered suitable for inclusion in the subject paTCE. In some embodiments, a TCE found to retain a suitable level of activity can be linked to one or more ELNN polypeptides, having at least about 80% sequence identity (e.g., at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% sequence identity) to a sequence from Tables 3a-3b.

TABLE 4

Exemplary conservative amino acid substitutions

| Original Residue | Exemplary Substitutions |
| --- | --- |
| Ala (A) | val; leu; ile |
| Arg (R) | lys; gin; asn |
| Asn (N) | gin; his; lys; arg |
| Asp (D) | Glu |
| Cys (C) | Ser |
| Gln (Q) | Asn |
| Glu (E) | Asp |
| Gly (G) | Pro |
| His (H) | asn: gin: lys: arg |
| Ile (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr(Y) | trp: phe: thr: ser |
| Val (V) | ile; leu; met; phe; ala; norleucine |

The present disclosure provides ELNNylated TCEs (such as paTCEs) that target PSMA, wherein TCE is a bispecific antibody (e.g., a bispecific TCE) that specifically binds to PSMA with one portion of the bispecific TCE and CD3 with the other portion of the bispecific TCE.

In some embodiments, the ELNNylated TCE comprises (1) a first portion comprising a first binding domain and a second binding domain, and (2) a second portion comprising a release segment, and (3) a third portion comprising an unstructured polypeptide mask (also sometimes referred to herein as a masking moiety).

In some embodiments, the ELNNylated TCE comprises the configuration of Formula Ia (depicted N-terminus to C-terminus):

(first portion)-(second portion)-(third portion)   (Ia)

wherein first portion is a bispecific antibody domain comprising two antigen binding domains as noted above wherein the first binding domain has specific binding affinity to PSMA (e.g., as expressed on a cancer cell) and the second binding domain has specific binding affinity to a CD3 (e.g., as expressed on an effector cell); the second portion comprises a release segment (RS) capable of being cleaved by a mammalian protease; and the third portion is a masking moiety that serves to mask the biological properties of the bispecific antibody domain. In some embodiments, the RS is a protease-cleavable release segment that is cleavable by a protease that is present in a tumor microenvironment.

In some embodiments in which the first portion comprises a binding domain comprising a VHH and a binding domain comprising a VL and VH, the first portion binding domains can be in the order (VL-VH)1-(VHH)2, wherein "1" and "2" represent the first and second binding domains, respectively, or (VH-VL)1-(VHH)2, or (VHH)1-(VL-VH)2, or (VHH)1-(VH-VL)2, wherein the paired binding domains are linked by a polypeptide linker (e.g., as described herein). In some embodiments in which the first portion comprises two binding domains that each comprise a VL and VH, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker (e.g., as described herein).

In some embodiments, the domain that binds PSMA is a VHH.

In some embodiments, the first portion binding domains comprise sequences provided in Tables 6a-6g, wherein Tables 6a-e show sequences that bind CD3 and Tables 6f-h show sequences that bind to PSMA; the RS sequence comprises a sequence provided in Tables 8a-8b (e.g., as described herein); and the masking moiety is an ELNN. In some embodiments, the masking moiety is an ELNN having at least about 90%, 91%, 92%, 93%, 94%, 95%, 96%, 97%, 98%, 99%, or 100% sequence identity to a sequence comprising the group of sequences set forth in Tables 3a-3b. In some embodiments, the composition is a recombinant fusion protein. In some embodiments, the portions are linked by chemical conjugation.

In some embodiments, the fusion protein comprises the configuration of Formula IIa (depicted N-terminus to C-terminus):

(third portion)-(second portion)-(first portion)     (IIa)

wherein first portion is a bispecific comprising two antigen binding domains wherein the first binding domain has specific binding affinity to a PSMA (e.g., as expressed on a cancer cell) and the second binding domain has specific binding affinity to CD3 (e.g., as expressed on an effector cell); the second portion comprises a release segment (RS) capable of being cleaved by a mammalian protease; and the third portion is a masking moiety that serves to mask the biological properties of the bispecific antibody domain. In some embodiments, the RS is a protease-cleavable release segment that is universally cleavable in a tumor microenvironment.

In some embodiments in which the first portion comprises a binding domain comprising a VHH and a binding domain comprising a VL and VH, the first portion binding domains can be in the order (VL-VH)1-(VHH)2, wherein "1" and "2" represent the first and second binding domains, respectively, or (VH-VL)1-(VHH)2, or (VHH)1-(VL-VH)2, or (VHH)1-(VH-VL)2, wherein the paired binding domains are linked by a polypeptide linker (e.g., as described herein). In some embodiments in which the first portion comprises two binding domains that each comprise a VL and VH, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker (e.g., as described herein).

In some embodiments, the domain that binds PSMA is a VHH.

In some embodiments, the first portion binding domains comprise sequences provided in Tables 6a-6g, wherein Tables 6a-e show sequences that bind CD3 and Tables 6f-h shows sequences that bind to PSMA; the RS sequence comprises a sequence provided in Tables 8a-8b (e.g., as described herein); and the masking moiety is an ELNN. In some embodiments, the masking moiety is an ELNN having at least about 90%, 91%, 92%, 93%, 94%, 95%, 96%, 97%, 98%, 99%, or 100% sequence identity to a sequence comprising the group of sequences set forth in Tables 3a-3b. In some embodiments, the composition is a recombinant fusion protein. In some embodiments, the portions are linked by chemical conjugation.

In some embodiments, a paTCE composition comprises the configuration of Formula IIIa (depicted N-terminus to C-terminus):

(fifth portion)-(fourth portion)-(first portion)-(second portion)-(third portion)     (IIIa)

wherein first portion is a bispecific comprising two antigen binding domains wherein the first binding domain has specific binding affinity to a PSMA (e.g., as expressed on a cancer cell) and the second binding domain has specific binding affinity to CD3 (e.g., as expressed on an effector cell); the second portion comprises a release segment (RS) capable of being cleaved by a mammalian protease; and the third portion is a masking moiety that serves to mask the biological properties of the bispecific antibody domain; the fourth portion comprises a release segment (RS) capable of being cleaved by a mammalian protease which may be identical or different from the second portion; and the fifth portion is a masking moiety that may be identical or may be different from the third portion.

In some embodiments in which the first portion comprises a binding domain comprising a VHH and a binding domain comprising a VL and VH, the first portion binding domains can be in the order (VL-VH)1-(VHH)2, wherein "1" and "2" represent the first and second binding domains, respectively, or (VH-VL)1-(VHH)2, or (VHH)1-(VL-VH)2, or (VHH)1-(VH-VL)2, wherein the paired binding domains are linked by a polypeptide linker (e.g., as described herein). In some embodiments in which the first portion comprises two binding domains that each comprise a VL and VH, the first portion binding domains can be in the order (VL-VH)1-(VL-VH)2, wherein "1" and "2" represent the first and second binding domains, respectively, or (VL-VH)1-(VH-VL)2, or (VH-VL)1-(VL-VH)2, or (VH-VL)1-(VH-VL)2, wherein the paired binding domains are linked by a polypeptide linker (e.g., as described herein).

In some embodiments, the domain that binds PSMA is a VHH.

In some embodiments, the first portion binding domains comprise sequences provided in Tables 6a-6g, wherein Tables 6a-e show sequences that bind CD3 and Tables 6f-h shows sequences that bind to PSMA; each RS sequence comprises, individually, a sequence provided in Tables 8a-8b (e.g., as described herein); and each masking moiety is, individually, an ELNN. In some embodiments, each masking moiety is an ELNN having at least about 90%, 91%, 92%, 93%, 94%, 95%, 96%, 97%, 98%, 99%, or 100% sequence identity to a sequence comprising the group of sequences set forth in Tables 3a-3b. In some embodiments, the paTCE is a recombinant fusion protein. In some embodiments, one or more portions of the paTCE are linked by chemical conjugation.

Provided herein are compositions that advantageously provide PSMA-targeted bispecific therapeutics that have more selectivity, greater half-life, and result in less toxicity and fewer side effects once they are cleaved by proteases found in the target tissues or tissues rendered unhealthy by a disease, such that the subject compositions have improved therapeutic index compared to bispecific antibody compositions known in the art. Such compositions are useful in the treatment of cancer. In some embodiments, when a paTCE is in proximity to a target tissue or cell bearing or secreting a protease capable of cleaving the RS, the bispecific binding domains are liberated from the ELNN(s) by the action of protease(s), removing a steric hindrance barrier, and rendering the TCE freer to exert its pharmacologic effect. This property is particularly advantageous in treating immunologically cold tumors that express PSMA. In some embodiments, a paTCE provided herein is activated at in a target tissue, wherein the target tissue is a solid tumor of an organ or system.

Binding Domains

In some embodiments, a binding domain provided herein comprises one or more full-length antibodies or one or more antigen-binding fragments thereof. Antigen-binding fragments of antibodies include any naturally occurring, enzymatically obtainable, synthetic, or genetically engineered polypeptides comprising a portion or portions of an antibody that specifically bind to an antigen. Antigen-binding fragments of an antibody may be derived, e.g., from full antibody molecules using any suitable standard techniques, such as proteolytic digestion or recombinant genetic engineering techniques involving the manipulation and expression of DNA encoding antibody variable and optionally constant domains. The terms binding domain and antibody domain are used interchangeably herein.

In some embodiments, single chain binding domains are used, such as but not limited to Fv, Fab, Fab', Fab'-SH, F(ab')2, linear antibodies, single domain antibodies, VHHs, single-chain antibody molecules (scFv), and diabodies capable of binding ligands or receptors associated with effector cells and antigens of diseased tissues or cells that are cancers, tumors, or other malignant tissues.

In some embodiments, the binding domain is a bispecific antibody domain, wherein the bispecific antibody domain comprises a first antigen binding domain that specifically binds to a first target and a second antigen binding domain that specifically binds to a second target. In some embodiments, the first antigen binding domain is a first antigen binding fragment (e.g., an scFv or an ISVD, such as a VHH) and the second antigen binding domain is a second antigen binding fragment (e.g., an scFv or an ISVD, such as a VHH).

In some embodiments, an antigen binding fragment (AF) (e.g., a first antigen binding fragment (AF1), and/or a second antigen binding fragment (AF2)) can (each independently) be a chimeric, a humanized, or a human antigen-binding fragment. The antigen binding fragment (AF) (e.g., a first antigen binding fragment (AF1), and/or a second antigen binding fragment (AF2)) can (each independently) be an Fv, Fab, Fab', Fab'-SH, linear antibody, VHH, or scFv.

In some embodiments, one or both antigen binding fragments (e.g., the first and/or second antigen binding fragments) can be configured as an (Fab')2 or a single chain diabody. In some embodiments, the bispecific antibody comprises a first binding domain with binding specificity to a cancer cell marker and a second binding domain with binding specificity to an effector cell antigen. In some embodiments, the binding domain for the tumor cell target is a variable domain of a T cell receptor that has been engineered to bind MHC that is loaded with a peptide fragment of a protein that is overexpressed by tumor cells.

In some embodiments, a paTCE is designed with consideration of the location of the target tissue protease as well as the presence of the same protease in healthy tissues not intended to be targeted, as well as the presence of the target ligand in healthy tissue but a greater presence of the ligand in unhealthy target tissue, in order to provide a wide therapeutic window. A "therapeutic window" refers to the difference between the minimal effective dose and the maximal tolerated dose for a given therapeutic composition. In some embodiments, to help achieve a wide therapeutic window for a TCE, the binding domains of the TCE are shielded by the proximity of a masking (e.g., ELNN) moiety or moieties such that the binding affinity of the intact composition for one, or both, of the ligands is reduced compared to the composition that has been cleaved by a mammalian protease, thereby releasing the first portion from the shielding effects of the masking moiety.

In some embodiments, a complete antigen recognition and binding site comprises a dimer of one heavy chain variable domain (VH) and one light chain variable domain (VL). Within each VH and VL chain are three complementarity determining regions (CDRs) that interact to define an antigen binding site on the surface of the VH-VL dimer; the six CDRs of a binding domain confer antigen binding specificity to the antibody or single chain binding domain. Framework sequences flanking the CDRs have a tertiary structure that is essentially conserved in native immunoglobulins across species, and the framework residues (FR) serve to hold the CDRs in their appropriate orientation. In some embodiments, a constant domain is not required for binding function but may aid in stabilizing VH-VL interaction. In some embodiments, a binding site can be a pair of VH-VL, VH-VH or VL-VL domains either of the same or of different immunoglobulins, however it is generally preferred to make single chain binding domains using the respective VH and VL chains from the parental antibody. In some embodiments, the order of VH and VL domains within the polypeptide chain is not limiting, provided the VH and VL domains are arranged so that the antigen binding site can properly fold. Thus, in some embodiments, a single chain binding domains comprising a VH and a VL (e.g., in an scFv) can have the VH and VL arranged as VL-VH or VL-VH.

In some embodiments, the arrangement of the V chains may be VH(cancer cell surface antigen)-VL(cancer cell surface antigen)-VL(effector cell antigen)-VH(effector cell antigen), VH(cancer cell surface antigen)-VL(cancer cell surface antigen)-VH(effector cell antigen)-VL(effector cell antigen), VL(cancer cell surface antigen)-VH(cancer cell surface antigen)-VL(effector cell antigen)-VH(effector cell antigen), VL(cancer cell surface antigen)-VH(cancer cell surface antigen)-VH(effector cell antigen)-VL(effector cell antigen), VHH(cancer cell surface antigen)-VH(effector cell antigen)-VL(effector cell antigen), VHH(cancer cell surface antigen)-VL(effector cell antigen)-VH(effector cell antigen), VL(cancer cell surface antigen)-VH(cancer cell surface antigen)-VHH(effector cell antigen), or VH(cancer cell surface antigen)-VL(cancer cell surface antigen)-VHH(effector cell antigen).

In some embodiments, the following orders are possible: VH (effector cell antigen)-VL(effector cell antigen)-VL (cancer cell surface antigen)-VH(cancer cell surface antigen), VH(effector cell antigen)-VL(effector cell antigen)-VH(cancer cell surface antigen)-VL(cancer cell surface antigen), VL(effector cell antigen)-VH(effector cell antigen)-VL(cancer cell surface antigen)-VH(cancer cell surface antigen), VL(effector cell antigen)-VH(effector cell antigen)-VH(cancer cell surface antigen)-VL(cancer cell surface antigen), VHH(effector cell antigen)-VH(cancer cell surface antigen)-VL(cancer cell surface antigen), VHH(effector cell antigen)-VL(cancer cell surface antigen)-VH (cancer cell surface antigen), VL(effector cell antigen)-VH (effector cell antigen)-VHH(cancer cell surface antigen), or VH(effector cell antigen)-VL(effector cell antigen)-VHH (cancer cell surface antigen).

As used herein, "N-terminally to" or "C-terminally to" and grammatical variants thereof denote relative location within the primary amino acid sequence rather than placement at the absolute N- or C-terminus of the bispecific single chain antibody. Hence, as a non-limiting example, a first binding domain which is "located C-terminally to" a second binding domain denotes that the first binding is located on the carboxyl side of the second binding domain within a bispecific single chain antibody, and does not exclude the possibility that an additional sequence, for example a linker and/or an ELNN, a His-tag, or another compound such as a radioisotope, is located at the C-terminus of the bispecific single chain antibody.

In some embodiments, a paTCE comprises a first portion comprising a first binding domain and a second binding domain wherein each of the binding domains is an scFv and wherein each scFv comprises one VL and one VH. In some embodiments, the paTCE compositions comprise a first portion comprising a first binding domain and a second binding domain wherein one of the binding domains is an scFV and the other binding domain is a VHH. In some embodiments, the CD3 binding domain may be an scFV (comprising example a sequence shown in any of Tables 6a-e) and the second binding domain is a VHH that binds PSMA. In some embodiments, a paTCE comprises a first portion comprising a first binding domain and a second binding domain wherein the binding domains are in a diabody configuration and wherein one domain comprises one VHH region and the other domain comprises one VL region and one VH region. Exemplary PSMA-binding VHH binding domains are shown in Table 6f. In some embodiments, a paTCE comprises a first portion comprising a first binding domain and a second binding domain wherein the binding domains are in a diabody configuration and wherein each domain comprises one VL region and one VH region. Exemplary PSMA-binding VH and VL regions can be derived from the sequences shown in Table 6g.

In non-limiting examples, a TCE can comprise a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to an antibody sequence identified herein. In some embodiments, a TCE comprises a bispecific sequence (e.g., a BsAb) comprising a first binding domain and a second binding domain, wherein the first binding domain has specific binding affinity to a tumor-specific marker or a cancer cell antigen, and exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired to a VHH sequence of an anti-PSMA antibody disclosed herein in Table 6f or paired VL and VH sequences of an anti-PSMA antibody disclosed herein in Table 6g; and wherein the second binding domain has specific binding affinity to an effector cell, and exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-CD3 antibody disclosed herein in any of Tables 6a-e.

In some embodiments, a TCE can comprise a binding domain (e.g., a VH and/or VL amino acid sequence) of or derived from an anti-CD3 antibody. Non-limiting examples of anti-CD3 antibodies include OKT3 (also called muromonab) and humanized anti-CD3 monoclonal antibody (hOKT31(Ala-Ala))(KC Herold et al., New England Journal of Medicine 346:1692-1698. 2002), as well as fragments and derivatives thereof that selectively bind to CD3. Additional examples are described in U.S. Pat. Nos. 5,885,573; 6,491, 916; and US Patent Application Publication No. 2021/0054077-A1, the entire contents of each of which are incorporated herein by reference. Additional non-limiting examples of anti-CD3 antibody sequences include those of pasotuxizumab (also known as AMG-212) and acapatamab (also known as AMG-160).

In some embodiments, a TCE can comprise a binding domain (e.g., a VH and/or VL amino acid sequence) of or derived from an anti-PSMA antibody. Non-limiting examples of anti-PSMA antibody sequences include those of pasotuxizumab and acapatamab.

In some embodiments, the TCE is pasotuxizumab. In some embodiments, the TCE is acapatamab.

The present disclosure provides immunoglobulin single variable domains (ISVDs) that bind PSMA. The present disclosure further provides nucleic acids encoding the ISVDs or polypeptides as well as vectors, hosts and methods to produce these ISVDs or polypeptides. Also provided are multispecific polypeptides comprising an ISVD according to the present disclosure and at least one CD3 binding domain, including paTCEs. Included are methods for treatment making use of the ISVDs or polypeptides according to the present disclosure. In some embodiments, the ISVD is a heavy-chain ISVD. In some embodiments, the ISVD is a VHH, a humanized VHH, or a camelized VH.

In some embodiments, the ISVD is a VHH.

Also provided is a nucleic acid molecule encoding the ISVD or polypeptide of the present disclosure or a vector comprising the nucleic acid.

The present disclosure also relates to a non-human host or host cell transformed or transfected with the nucleic acid or vector that encodes an ISVD or polypeptide disclosed herein.

The present disclosure furthermore relates to compositions comprising an ISVD or polypeptide disclosed herein, such as a pharmaceutical composition.

Included herein is a method for producing an ISVD or polypeptide as disclosed herein, the method comprising the steps of:
a. expressing, in a host cell or host organism or in another expression system, a nucleic acid sequence encoding the ISVD or polypeptide; optionally followed by:
b. isolating and/or purifying the ISVD or polypeptide.

Provided herein are compositions and polypeptides comprising an ISVD for use as a medicament. In some embodiments, the polypeptide or composition is for use in the treatment of a proliferative disease. In some embodiments, the proliferative disease is cancer.

The present disclosure also provides a method of treatment comprising the step of administering a composition or polypeptide comprising an ISVD to a subject in need thereof. In some embodiments, the method of treatment is for treating a proliferative disease. In some embodiments, the proliferative disease is cancer.

Included herein are composition and polypeptides comprising an ISVD for use in the preparation of a medicament. In some embodiments, the medicament is used in the treatment of a proliferative disease. In some embodiments, the proliferative disease is cancer.

The term "immunoglobulin single variable domain" (ISVD), defines immunoglobulin molecules wherein the antigen binding site is present on, and formed by, a single immunoglobulin domain. This sets immunoglobulin single variable domains apart from "conventional" immunoglobulins (e.g. monoclonal antibodies) or their fragments (such as Fab, Fab', F(ab')2, scFv, di-scFv), wherein two immunoglobulin domains, in particular two variable domains, interact to form an antigen binding site. Typically, in conventional immunoglobulins, a heavy chain variable domain (VH) and a light chain variable domain (VL) interact to form an antigen binding site. In this case, the complementarity determining regions (CDRs) of both VH and VL will contribute to the antigen binding site, i.e. a total of 6 CDRs will be involved in antigen binding site formation, whereas in an ISVD only 3 CDRs from a single domain are contributing to the antigen binding site formation.

In view of the above definition, the antigen-binding domain of a conventional 4-chain antibody (such as an IgG, IgM, IgA, IgD or IgE molecule; known in the art) or of a Fab fragment, a F(ab')2 fragment, an Fv fragment such as a disulphide linked Fv or a scFv fragment, or a diabody (all known in the art) derived from such conventional 4-chain antibody, would normally not be regarded as an immunoglobulin single variable domain, as, in these cases, binding to the respective epitope of an antigen would normally not occur by one (single) immunoglobulin domain but by a pair of (associating) immunoglobulin domains such as light and heavy chain variable domains, i.e., by a VH-VL pair of immunoglobulin domains, which jointly bind to an epitope of the respective antigen.

In contrast, immunoglobulin single variable domains are capable of specifically binding to an epitope of the antigen without pairing with an additional immunoglobulin variable domain. The binding site of an immunoglobulin single variable domain is formed by a single VH, a single VHH or single VL domain.

As such, the single variable domain may be a light chain variable domain sequence (e.g., a VL-sequence) or a suitable fragment thereof; or a heavy chain variable domain sequence (e.g., a VH-sequence or VHH sequence) or a suitable fragment thereof; as long as it is capable of forming a single antigen binding unit (i.e., a functional antigen binding unit that essentially consists of the single variable domain, such that the single antigen binding domain does not need to interact with another variable domain to form a functional antigen binding unit).

An immunoglobulin single variable domain (ISVD) can for example be a heavy chain ISVD, such as a VH, VHH, including a camelized VH or humanized VHH. In some embodiments, it is a VHH, including a camelized VH or humanized VHH. Heavy chain ISVDs can be derived from a conventional four-chain antibody or from a heavy chain antibody.

For example, the immunoglobulin single variable domain may be a single domain antibody (or an amino acid sequence that is suitable for use as a single domain antibody), a "dAb" or dAb (or an amino acid sequence that is suitable for use as a dAb); other single variable domains, or any suitable fragment of any one thereof.

In some embodiments, the immunoglobulin single variable domain may be a NANOBODY® molecule or a suitable antigen-binding fragment thereof. NANOBODY® is a registered trademark of Ablynx N.V.

"VHH domains", also known as VHHs, VHH regions, VHH antibody fragments, and VHH antibodies, have originally been described as the antigen binding immunoglobulin variable domain of "heavy chain antibodies" (i.e., of "antibodies devoid of light chains"; Hamers-Casterman et aL. Nature 363: 446-448, 1993). The term "VHH domain" has been chosen in order to distinguish these variable domains from the heavy chain variable domains that are present in conventional 4-chain antibodies (which are referred to herein as "VH domains", "VH regions", and "VHs") and from the light chain variable domains that are present in conventional 4-chain antibodies (which are referred to herein as "VL domains", "VL regions", and "VLs"). For a further description of VHHs, reference is made to the review article by Muyldermans (Reviews in Molecular Biotechnology 74: 277-302, 2001).

Typically, the generation of immunoglobulins involves the immunization of experimental animals, fusion of immunoglobulin producing cells to create hybridomas and screening for the desired specificities. Alternatively, immunoglobulins can be generated by screening of naïve or synthetic libraries e.g. by phage display.

The generation of immunoglobulin sequences has been described extensively in various publications, among which WO 94/04678, Hamers-Casterman et aL. 1993 and Muyldermans et aL. 2001 can be exemplified. In these methods, camelids are immunized with the target antigen in order to induce an immune response against the target antigen. The repertoire of VHHs obtained from the immunization is further screened for VHHs that bind the target antigen.

In these instances, the generation of antibodies requires purified antigen for immunization and/or screening. Antigens can be purified from natural sources, or in the course of recombinant production.

Immunization and/or screening for immunoglobulin sequences can be performed using peptide fragments of such antigens.

The present technology may use immunoglobulin sequences of different origins, comprising mouse, rat, rabbit, donkey, human and camelid immunoglobulin sequences. The technology also includes fully human, humanized, or chimeric sequences. For example, the technology comprises camelid immunoglobulin sequences and humanized camelid immunoglobulin sequences, or camelized domain antibodies, e.g. camelized dAb as described by Ward et aL. (see for example WO 94/04678 and Davies and Riechmann (1994 and 1996)). In some embodiments, the technology also uses fused immunoglobulin sequences, e.g. forming a multivalent and/or multispecific construct (for multivalent and multispecific polypeptides containing one or more VHH domains and their preparation, reference is also made to Conrath et al., J. Biol. Chem., Vol. 276, 10. 7346-7350, 2001, as well as to for example WO 96/34103 and WO 99/23221), and immunoglobulin sequences comprising tags or other functional moieties, e.g. toxins, labels, radiochemicals, etc., which are derivable from the immunoglobulin sequences of the present technology.

A "humanized VHH" comprises an amino acid sequence that corresponds to the amino acid sequence of a naturally occurring VHH domain, but that has been "humanized", i.e. by replacing one or more amino acid residues in the amino acid sequence of the naturally occurring VHH sequence (and in particular in the framework sequences) by one or more of the amino acid residues that occur at the corresponding position(s) in a VH domain from a conventional 4-chain antibody from a human being (e.g., indicated above). This can be performed in a manner known per se, which will be clear to the skilled person, for example based on the further description herein and the prior art (e.g., WO 2008/020079). Again, it should be noted that such humanized VHHs can be obtained in any suitable manner known per se and thus are not strictly limited to polypeptides that have been obtained using a polypeptide that comprises a naturally occurring VHH domain as a starting material.

A "camelized VH" comprises an amino acid sequence that corresponds to the amino acid sequence of a naturally occurring VH domain, but that has been "camelized", i.e., by replacing one or more amino acid residues in the amino acid sequence of a naturally occurring VH domain from a conventional 4-chain antibody by one or more of the amino acid residues that occur at the corresponding position(s) in a VHH domain of a heavy chain antibody. This can be performed in a manner known per se, which will be clear to the skilled person, for example based on the further description herein and the prior art (e.g., WO 2008/020079). Such "camelizing" substitutions are preferably inserted at amino acid positions that form and/or are present at the VH-VL interface, and/or at the so-called Camelidae hallmark residues, as defined herein (see for example WO 94/04678 and Davies and Riechmann (1994 and 1996), supra). In some embodiments, the VH sequence that is used as a starting material or starting point for generating or designing the camelized VH is preferably a VH sequence from a mammal, e.g., the VH sequence of a human being, such as a VH3 sequence. However, it should be noted that such camelized VH can be obtained in any suitable manner known per se and thus are not strictly limited to polypeptides that have been obtained using a polypeptide that comprises a naturally occurring VH domain as a starting material.

In some embodiments, the structure of an immunoglobulin single variable domain sequence can be considered to be comprised of four framework regions ("FRs"), which are referred to in the art and herein as "Framework region 1" ("FR1"); as "Framework region 2" ("FR2"); as "Framework region 3" ("FR3"); and as "Framework region 4" ("FR4"), respectively; which framework regions are interrupted by three complementary determining regions ("CDRs"), which are referred to in the art and herein as "Complementarity Determining Region 1" ("CDR1"); as "Complementarity Determining Region 2" ("CDR2"); and as "Complementarity Determining Region 3" ("CDR3"), respectively.

As further described in paragraph q) on pages 58 and 59 of WO 08/020079, the amino acid residues of an immunoglobulin single variable domain can be numbered according to the general numbering for VH domains given by Kabat et al. ("Sequence of proteins of immunological interest", US Public Health Services, NIH Bethesda, MD, Publication No. 91), as applied to VHH domains from Camelids in the article of Riechmann and Muyldermans, 2000 (J. Immunol. Methods 240 (1-2): 185-195; see for example FIG. 2 of this publication). It should be noted that—as is well known in the art for VH domains and for VHH domains—the total number of amino acid residues in each of the CDRs may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering). This means that, generally, the numbering according to Kabat may or may not correspond to the actual numbering of the amino acid residues in the actual sequence. In some embodiments, the total number of amino acid residues in a VH domain and a VHH domain is in the range of from 110 to 135. It should however be noted that smaller and longer sequences may also be suitable for the purposes described herein.

Determination of CDR regions may also be done according to different methods.

In some embodiments, VHH CDR sequences were determined according to the AbM definition as described in Martin 2010 (In: Kontermann and Dubel (Eds.) 2010, Antibody Engineering, vol 2, Springer Verlag Heidelberg Berlin, Chapter 3, pp. 33-51). According to this method, FR1 comprises the amino acid residues at positions 1-25, CDR1 comprises the amino acid residues at positions 26-35, FR2 comprises the amino acids at positions 36-49, CDR2 comprises the amino acid residues at positions 50-58, FR3 comprises the amino acid residues at positions 59-94, CDR3 comprises the amino acid residues at positions 95-102, and FR4 comprises the amino acid residues at positions 103-113.

In some embodiments, CDR sequences are determined according to Kabat (Martin 2010, In: Kontermann and Dübel (eds.), Antibody Engineering Vol. 2, Springer Verlag Heidelberg Berlin, Chapter 3, pp. 33-51). According to this method, FR1 of an immunoglobulin single variable domain comprises the amino acid residues at positions 1-30, CDR1 of an immunoglobulin single variable domain comprises the amino acid residues at positions 31-35, FR2 of an immunoglobulin single variable domain comprises the amino acids at positions 36-49, CDR2 of an immunoglobulin single variable domain comprises the amino acid residues at positions 50-65, FR3 of an immunoglobulin single variable domain comprises the amino acid residues at positions 66-94, CDR3 of an immunoglobulin single variable domain comprises the amino acid residues at positions 95-102, and FR4 of an immunoglobulin single variable domain comprises the amino acid residues at positions 103-113.

In some embodiments, FR1 comprises the amino acid residues at positions 1-25, CDR1 comprises the amino acid residues at positions 26-35, FR2 comprises the amino acids at positions 36-49, CDR2 comprises the amino acid residues at positions 50-58, FR3 comprises the amino acid residues at positions 59-94, CDR3 comprises the amino acid residues at positions 93-102, and FR4 comprises the amino acid residues at positions 103-113.

In some embodiments, FR1 comprises the amino acid residues at positions 1-25, CDR1 comprises the amino acid residues at positions 26-35, FR2 comprises the amino acids at positions 36-49, CDR2 comprises the amino acid residues at positions 50-58, FR3 comprises the amino acid residues at positions 59-94, CDR3 comprises the amino acid residues at positions 93-102, and FR4 comprises the amino acid residues at positions 103-126.

In such an immunoglobulin sequence, the framework sequences may be any suitable framework sequences, and examples of suitable framework sequences will be clear to the skilled person, for example on the basis the standard handbooks and the further disclosure and references mentioned herein.

In some embodiments, the framework sequences are a suitable combination of immunoglobulin framework sequences or framework sequences that have been derived from immunoglobulin framework sequences (for example, by humanization or camelization). For example, the framework sequences may be framework sequences derived from a light chain variable domain (e.g. a VL-sequence) and/or from a heavy chain variable domain (e.g. a VH-sequence or VHH sequence). In some embodiments, the framework sequences are either framework sequences that have been derived from a VHH-sequence (in which the framework sequences may optionally have been partially or fully humanized) or are conventional VH sequences that have been camelized (as defined herein).

In some embodiments, the framework sequences present in the ISVD sequence used in the technology may contain one or more of hallmark residues (as defined herein), such that the ISVD sequence is a VHH, including a humanized VHH or camelized VH. Some non-limiting examples of (suitable combinations of) such framework sequences will become clear from the further disclosure herein.

Again, as generally described herein for the immunoglobulin sequences, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived).

However, it should be noted that the technology is not limited as to the origin of the ISVD sequence (or of the nucleotide sequence used to express it), nor as to the way that the ISVD sequence or nucleotide sequence is (or has been) generated or obtained. Thus, the ISVD sequences may be naturally occurring sequences (from any suitable species) or synthetic or semi-synthetic sequences. In a specific but non-limiting aspect, the ISVD sequence is a naturally occurring sequence (from any suitable species) or a synthetic or semi-synthetic sequence, including but not limited to "humanized" (as disclosed herein) immunoglobulin sequences (such as partially or fully humanized mouse or rabbit immunoglobulin sequences, and in particular partially or fully humanized VHH sequences), "camelized" (as disclosed herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing.

Similarly, nucleotide sequences may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

As described above, an ISVD may be an ISVD or a suitable fragment thereof. For a general description of ISVDs, reference is made to the further description below, as well as to the references cited herein. In this respect, it should however be noted that this description and the prior art mainly described ISVDs of the so-called "VH3 class" (i.e. ISVDs with a high degree of sequence homology to human germline sequences of the VH3 class such as DP-47, DP-51, or DP-29). It should however be noted that the technology in its broadest sense can generally use any type of ISVD, and for example also uses the ISVDs belonging to the so-called "VH4 class" (i.e. ISVDs with a high degree of sequence homology to human germline sequences of the VH4 class such as DP-78), as for example described in WO 2007/118670.

Generally, ISVDs (in particular VHH sequences, including (partially) humanized VHH sequences and camelized VH sequences) can be characterized by the presence of one or more "Hallmark residues" (as described herein) in one or more of the framework sequences (again as further described herein). Thus, generally, an ISVD can be defined as an immunoglobulin sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In some embodiments, an ISVD can be an immunoglobulin sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

In some embodiments, an ISVD can be an immunoglobulin sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the amino acid residues at positions 11, 37, 44, 45, 47, 83, 84, 103, 104 and 108 according to the Kabat numbering are selected from the Hallmark residues mentioned in Table 5 below.

TABLE 5

Hallmark Residues in ISVDs

| Position | Human $V_H3$ | Hallmark Residues |
| --- | --- | --- |
| 11 | L, V; predominantly L | L, S, V, M, W, F, T, Q, E, A, R, G, K, Y, N, P, I; preferably L |
| 37 | V, I, F; usually V | $F^{(1)}$, Y, V, L, A, H, S, I, W, C, N, G, D, T, P, preferably $F^{(1)}$or Y |
| $44^{(8)}$ | G | $E^{(3)}$, $Q^{(3)}$, $G^{(2)}$, D, A, K, R, L, P, S, V, H, T, N, W, M, I; preferably $G^{(2)}$, $E^{(3)}$or $Q^{(3)}$; most preferably $G^{(2)}$ or $Q^{(3)}$ |
| $45^{(8)}$ | L | $L^{(2)}$, $R^{(3)}$, P, H, F, G, Q, S, E, T, Y, C, I, D, V; preferably $L^{(2)}$or $R^{(3)}$ |
| $47^{(8)}$ | W, Y | $F^{(1)}$, $L^{(1)}$or $W^{(2)}$G, I, S, A, V, M, R, Y, E, P, T, C, H, K, Q, N, D; preferably $W^{(2)}$, $L^{(1)}$ or $F^{(1)}$ |
| 83 | R or K; usually R | R, $K^{(5)}$, T, $E^{(5)}$, Q, N, S, I, V, G, M, L, A, D, Y, H; preferably K or R; most preferably K |
| 84 | A, T, D; predominantly A | $P^{(5)}$, S, H, L, A, V, I, T, F, D, R, Y, N, Q, G, E; preferably P |
| 103 | W | $W^{(4)}$, $R^{(6)}$, G, S, K, A, M, Y, L, F, T, N, V, Q, $P^{(6)}$, E, C; preferably W |

TABLE 5-continued

Hallmark Residues in ISVDs

| Position | Human V$_H$3 | Hallmark Residues |
|---|---|---|
| 104 | G | G, A, S, T, D, P, N, E, C, L; preferably G |
| 108 | L, M or T; predominantly L | Q, L$^{(7)}$, R, P, E, K, S, T, M, A, H; preferably Q or L$^{(7)}$ |

Notes:
$^{(1)}$In particular, but not exclusively, in combination with KERE (SEQ ID NO: 9408) or KQRE (SEQ ID NO: 9409) at positions 43-46.
$^{(2)}$Usually as GLEW(SEQ ID NO: 9410) at positions 44-47.
$^{(3)}$Usually as KERE(SEQ ID NO: 9408) or KQRE(SEQ ID NO: 9409) at positions 43-46, e.g. as KEREL (SEQ ID NO: 9411), KEREF (SEQ ID NO: 9412), KQREL (SEQ ID NO: 9413), KQREF (SEQ ID NO: 9414), KEREG (SEQ ID NO: 9415), KQREW (SEQ ID NO: 9416) or KQREG (SEQ ID NO: 9417) at positions 43-47. Alternatively, also sequences such as TERE (SEQ ID NO: 9418) (for example TEREL (SEQ ID NO: 9419)), TQRE (SEQ ID NO: 9420) (for example TQREL (SEQ ID NO: 9421)), KECE (SEQ ID NO: 9422) for example KECEL (SEQ ID NO: 9423) or KECER (SEQ ID NO: 9424)), KQCE (SEQ ID NO: 9425) (for example KQCEL (SEQ ID NO: 9426)), RERE (SEQ ID NO: 9427) (for example REREG (SEQ ID NO: 9428)), RQRE (SEQ ID NO: 9429) (for example RQREL (SEQ ID NO: 9430), RQREF (SEQ ID NO: 9431) or RQREW (SEQ ID NO: 9432)), QERE (SEQ ID NO: 9433) (for example QEREG (SEQ ID NO: 9434)), QQRE (SEQ ID NO: 9435), (for example QQREW (SEQ ID NO: 9436), QQREL (SEQ ID NO: 9437) or QREF (SEQ ID NO: 9438)), KGRE (SEQ ID NO: 9439) (for example KGREG (SEQ ID NO: 9440)), KDRE (SE ID NO: 9441) (for example KDREV (SEQ ID NO: 9442)) are possible. Some other possible, but less preferred sequences include for example DECKL (SEQ ID NO: 9443) and NVCEL (SEQ ID NO: 9444).
$^{(4)}$With both GLEW (SEQ ID NO: 9410) at positions 44-47 and KERE (SEQ ID NO: 9408) or KQRE (SEQ ID NO: 9409) at positions 43-46.
$^{(5)}$Often as KP or EP at positions 83-84 of naturally occurring VHH domains.
$^{(6)}$In particular, but not exclusively, in combination with GLEW (SEQ ID NO: 9410) at positions 44-47.
$^{(7)}$With the proviso that when positions 44-47 are GLEW(SEQ ID NO: 9410), position 108 is always Q in (non-humanized) VHH sequences that also contain a W at 103.
$^{(8)}$The GLEW(SEQ ID NO: 9410) group also contains GLEW(SEQ ID NO: 9410)-like sequences at positions 44-47, such as for example GVEW(SEQ ID NO: 9445), EPEW (SEQ ID NO: 9446), GLER (SEQ ID NO: 9447), DQEW (SEQ ID NO: 9448), DLEW (SEQ ID NO: 9449), GIEW (SEQ ID NO: 9450), ELEW (SEQ ID NO: 9451), GPEW (SEQ ID NO: 9452), EWLP (SEQ ID NO: 9453), GPER (SEQ ID NO: 9454), GLER (SEQ ID NO: 9447) and ELEW (SEQ ID NO: 9451).

In some embodiments, technology provided herein uses ISVDs that can bind to PSMA. In the context of the present technology, "binding to" a certain target molecule has the usual meaning in the art as understood in the context of antibodies and their respective antigens.

In some embodiments, an ISVD (such as a VHH) or multispecific-multivalent polypeptide exhibits reduced binding by pre-existing antibodies in human serum. To this end, in some embodiments, the polypeptide exhibits a valine (V) at amino acid position 11 and a leucine (L) at amino acid position 89 (according to Kabat numbering) in an ISVD. For example, the following sequence:

```
                                        (SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS
``` may be modified to be the following sequence:

```
                                        (SEQ ID NO: 566)
QVQLVESGGGVVQPGRSLRLSCAASGRTFGIYVWGWFRQAPGKEREFVG

AMSWSGSNRKVSDSVKGRFTISRDNSKNTLYLQMNSLRALDTAVYYCAA

SNKEYGRTWYDFNESDYWGQGTQVTVSS
```

In some embodiments, the polypeptide exhibits an extension of 1 to 5 (preferably naturally occurring) amino acids, such as a single alanine (A) extension, at the C-terminus of an ISVD (e.g., a C-terminal ISVD of a fusion protein or an ISVD that is not fused to any other polypeptide). The C-terminus of an ISVD is normally VTVSS (SEQ ID NO: 574). For example, the following sequence:

```
                                        (SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS,
``` may be modified to be any one of the following sequences:

```
                                        (SEQ ID NO: 567)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSSA, (SEQ ID NO: 568)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSSAA, (SEQ ID NO: 569)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSSAAA, (SEQ ID NO: 570)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSSAAAA,
or (SEQ ID NO: 571)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSSAAAAA.
```

In some embodiments, the polypeptide exhibits a lysine (K) or glutamine (Q) at position 110 (according to Kabat numbering) in at least one ISVD.

For example, the following sequence:

```
                                        (SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS
``` may be modified to be any one of the following sequences:

```
                                        (SEQ ID NO: 572)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDKNESDYWGQGTQVTVSS
or (SEQ ID NO: 573)
QVQLVESGGGVVQPGRSLRLSCAASGRTFGIYVWGWFRQAPGKEREFVGA

MSWSGSNRKVSDSVKGRFTISRDNSKNTLYLQMNSLRAEDTAVYYCAASN

KEYGRTWYDQNESDYWGQGTQVTVSS.
```

In some embodiments, the ISVD exhibits a lysine (K) or glutamine (Q) at position 112 (according to Kabat numbering) in at least on ISVD. In these embodiments, the C-terminus of the ISVD is VKVSS (SEQ ID NO: 575), VQVSS (SEQ ID NO: 576), VTVKS (SEQ ID NO: 577), VTVQS (SEQ ID NO: 578), VKVKS (SEQ ID NO: 579), VKVQS (SEQ ID NO: 580), VQVKS (SEQ ID NO: 581), or VQVQS (SEQ ID NO: 582) such that after addition of a single alanine the C-terminus of the polypeptide for example exhibits the sequence VTVSSA (SEQ ID NO: 583), VKVSSA (SEQ ID NO: 584), VQVSSA (SEQ ID NO: 585), VTVKSA (SEQ ID NO: 586), VTVQSA (SEQ ID NO: 587), VKVKSA (SEQ ID NO: 588), VKVQSA (SEQ ID NO: 589), VQVKSA (SEQ ID NO: 590), or VQVQSA (SEQ ID NO: 591), preferably VTVSSA (SEQ ID NO: 583).

In some embodiments, the polypeptide exhibits a valine (V) at amino acid position 11 and a leucine (L) at amino acid position 89 (according to Kabat numbering) in at least the C-terminal ISVD, optionally a lysine (K) or glutamine (Q) at position 110 (according to Kabat numbering) in at least one ISVD, and exhibits an extension of 1 to 5 (preferably naturally occurring) amino acids, such as a single alanine (A) extension, at the C-terminus of the C-terminal ISVD (such that the C-terminus of the polypeptide for example consists of the sequence VTVSSA (SEQ ID NO: 583), VKVSSA (SEQ ID NO: 584) or VQVSSA (SEQ ID NO: 585), preferably VTVSSA (SEQ ID NO: 583)). See e.g., WO2012/175741 and WO2015/173325 for further information in this regard.

As will be clear from the further description above and herein, the ISVDs of the present technology can be used as "building blocks" to form polypeptides of the present technology, e.g., by suitably combining them with other groups, residues, moieties or binding units, in order to form compounds or fusion proteins as described herein (such as, without limitations, the bi-/tri-/tetra-/multivalent and bi-/tri-/tetra-/multispecific polypeptides of the present technology described herein), which combine within one molecule one or more desired properties or biological functions. A polypeptide with multiple ISVDs is also referred to herein as a "ISVD construct" or "ISVD format".

The terms "specificity", "binding specifically" or "specific binding" refer to the number of different target molecules, such as antigens, from the same organism to which a particular binding unit, such as an ISVD (e.g., a VHH) or an scFv, can bind with sufficiently high affinity (see below). "Specificity", "binding specifically" or "specific binding" are used interchangeably herein with "selectivity", "binding selectively" or "selective binding". Binding units, such as VHHs and scFvs, preferably specifically bind to their designated targets.

The specificity/selectivity of a binding unit can be determined based on affinity. The affinity denotes the strength or stability of a molecular interaction. The affinity is commonly given as by the $K_D$ which is expressed in units of mol/liter (or M).

The affinity is a measure for the binding strength between a moiety and a binding site on the target molecule: the lower the value of the $K_D$, the stronger the binding strength between a target molecule and a targeting moiety.

Typically, binding units used in the present technology (such as ISVDs or scFvs) will bind to their targets with a $K_D$ of $10^{-5}$ to $10^{-12}$ moles/liter or less, and preferably $10^{-7}$ to $10^{-12}$ moles/liter or less and more preferably $10^{-8}$ to $10^{-12}$ moles/liter.

In some embodiments, a $K_D$ value greater than $10^{-4}$ mol/liter is considered nonspecific. In some embodiments, a $K_D$ value less than $10^{-4}$ mol/liter is considered specific.

The $K_D$ for biological interactions, such as the binding of antibody sequences to an antigen, which are considered specific are typically in the range of 10000 nM or 10 μM to 0.001 nM or 1 pM or less.

Accordingly, specific/selective binding may mean that—using the same measurement method, e.g. SPR—a binding unit (or polypeptide comprising the same) binds to PSMA with a $K_D$ value of $10^{-5}$ to $10^{-12}$ moles/liter or less and binds to different targets with a $K_D$ value greater than $10^{-4}$ moles/liter.

Thus, the ISVD preferably exhibits at least half the binding affinity, e.g., at least the same binding affinity, to human PSMA as compared to an ISVD consisting of the amino acid sequence of QVQLVESGGGVVQPGRSLRLS-CAASGRTFGIYVWGWFRQAPGKEREFVGAMSWSG-SNRKV SDSVKGRFTISRDNSKNTLYLQMNSLRAED-TAVYYCAASNKEYGRTWYDFNESDYWGQGTQ VTVSS (SEQ ID NO: 549), wherein the binding affinity is measured using the same method, such as SPR.

Specific binding to a certain target from a certain species does not exclude that the binding unit can also specifically bind to the analogous target from a different species. For example, specific binding to human PSMA does not exclude that the binding unit (or a polypeptide comprising the same) can also specifically bind to PSMA from cynomolgus monkeys.

Specific binding of a binding unit to its designated target can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein.

The dissociation constant may be, e.g., the actual or apparent dissociation constant, as will be clear to the skilled person. Methods for determining the dissociation constant will be clear to the skilled person, and for example include the techniques mentioned below.

The affinity of a molecular interaction between two molecules can be measured via different techniques known per se, such as the well-known surface plasmon resonance (SPR) biosensor technique (see for example Ober et al. 2001, Intern. Immunology 13: 1551-1559). The term "surface plasmon resonance", as used herein, refers to an optical phenomenon that allows for the analysis of real-time biospecific interactions by detection of alterations in protein concentrations within a biosensor matrix, where one molecule is immobilized on the biosensor chip and the other molecule is passed over the immobilized molecule under flow conditions yielding $k_{on}$, $k_{off}$ measurements and hence $K_D$ values. This can for example be performed using the well-known BIAcore® system (BIAcore International AB, a GE Healthcare company, Uppsala, Sweden and Piscataway, NJ). For further descriptions, see Jonsson et al. (1993, Ann. Biol. Clin. 51: 19-26), Jonsson et al. (1991 Biotechniques 11: 620-627), Johnsson et al. (1995, J. Mol. Recognit. 8: 125-131), and Johnnson et al. (1991, Anal. Biochem. 198: 268-277).

Another well-known biosensor technique to determine affinities of biomolecular interactions is bio-layer interferometry (BLI) (see for example Abdiche et al. 2008, Anal. Biochem. 377: 209-217). The term "bio-layer Interferometry" or "BLI", as used herein, refers to a label-free optical technique that analyzes the interference pattern of light reflected from two surfaces: an internal reference layer (reference beam) and a layer of immobilized protein on the biosensor tip (signal beam). A change in the number of molecules bound to the tip of the biosensor causes a shift in the interference pattern, reported as a wavelength shift (nm), the magnitude of which is a direct measure of the number of molecules bound to the biosensor tip surface. Since the interactions can be measured in real-time, association and dissociation rates and affinities can be determined. BLI can for example be performed using the well-known Octet® Systems (ForteBio, a division of Pall Life Sciences, Menlo Park, USA).

Alternatively, affinities can be measured in Kinetic Exclusion Assay (KinExA) (see for example Drake et al. 2004, Anal. Biochem., 328: 35-43), using the KinExA® platform (Sapidyne Instruments Inc, Boise, USA). The term "KinExA", as used herein, refers to a solution-based method to measure true equilibrium binding affinity and kinetics of unmodified molecules. Equilibrated solutions of an antibody/antigen complex are passed over a column with beads precoated with antigen (or antibody), allowing the free antibody (or antigen) to bind to the coated molecule. Detection of the antibody (or antigen) thus captured is accomplished with a fluorescently labeled protein binding the antibody (or antigen).

The GYROLAB® immunoassay system provides a platform for automated bioanalysis and rapid sample turnaround (Fraley et al. 2013, Bioanalysis 5: 1765-74).

In some embodiments, an ISVD provided herein has an on-rate constant ($k_{on}$) for binding to the human PSMA selected from the group consisting of at least about $10^3$ $M^{-1}s^{-1}$, at least about $10^4$ $M^{-1}s^{-1}$, and at least about $10^5$ $M^{-1}s^{-1}$, e.g., as measured by SPR, such as performed on a ProteOn XPR36 instrument, e.g., at 25°.

In some embodiments, an ISVD provided herein has an a $k_{on}$ for binding to the non-human primate PSMA selected from the group consisting of at least about $10^3$ $M^{-1}s^{-1}$, at least about $10^4$ $M^{-1}s^{-1}$, and at least about $10^5$ $M^{-1}s^{-1}$, e.g., as measured by SPR, such as performed on a ProteOn XPR36 instrument, e.g., at 25° C.

In some embodiments, an ISVD provided herein has a $k_{off}$ for binding to the human PSMA selected from the group consisting of at most about $10^{-2}$ $s^{-1}$, at most about $10^{-3}$ $s^{-1}$, and at most about $10^{-4}$ $s^{-1}$, e.g., as measured by SPR, such as performed on a ProteOn XPR36 instrument, preferably at 25° C.

In some embodiments, an ISVD provided herein has a $k_{off}$ for binding to the non-human primate PSMA selected from the group consisting of at most about $10^{-1}$ $s^{-1}$, at most about $10^{-2}$ $s^{-1}$, at most about $10^{-3}$ $s^{-1}$, and at most about $10^{-4}$ $s^{-1}$, e.g., as measured by SPR, such as performed on a ProteOn XPR36 instrument, e.g., at 25° C.

In some embodiments, an ISVD provided herein has an affinity ($K_D$) for binding to the human PSMA selected from the group consisting of at most about $10^{-6}$ M, at most about $10^{-7}$ M, at most about $10^{-8}$ M, at most about $10^{-8}$ M, and at most about $10^{-9}$ M, e.g., as measured by SPR, such as performed on a ProteOn XPR36 instrument, e.g., at 25° C.

In some embodiments, an ISVD provided herein has a $K_D$ for binding to the non-human primate PSMA selected from the group consisting of at most about $10^{-6}$ M, at most about $10^{-7}$ M, and at most about $10^{-8}$ M, e.g., as measured by SPR, such as performed on a ProteOn XPR36 instrument, e.g., at 25° C.

In some embodiments, the PSMA binding ISVD of the present technology bind to the human PSMA with the same or lower off rate constant ($k_{off}$) compared to QVQLVESGGGVVQPGRSLRLSCAAS-GRTFGIYVWGWFRQAPGKEREFVGAMSWSGSNRKVSDSVKGRFTISRDNSKNTLYLQMNSLRAEDTAVYY-CAASNKEYGRTWYDFNESDYWGQGTQ VTVSS (SEQ ID NO: 549). In some embodiments, the ISVD of the present technology binds to non-human primate PSMA with the same or lower $k_{off}$ compared to an ISVD of (SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

In some embodiments, a paTCE comprises a binding domain that is an scFv and a binding domain that is a VHH. In some embodiments, the scFv comprises VL and VH domains and specificity binds to an effector cell antigen (such as CD3), and the VHH domain specifically binds a cancer cell antigen (such as PSMA). In some embodiments, the scFv comprises six CDRs. In some embodiments, the scFv that comprises VH and VL regions comprising amino acid sequences that are at least about 90%, or 91%, or 92%, or 93%, or 94%, or 95%, or 96%, or 97%, or 98%, or 99% identical to, or are identical to, paired VL and VH sequences of an anti-CD3 antibody identified in Table 6a. In some embodiments, the scFv comprises a CDR-H1 region, a CDR-H2 region, a CDR-H3 region, a CDR-L1 region, a CDR-L2 region, and a CDR-L3 region of paired VL and VH sequences of an anti-CD3 antibody identified in Table 6a. In some embodiments, the VHH is derived from an anti-PSMA antibody identified as the antibodies set forth in Table 6f. In some embodiments, the VHH comprises an amino acid sequence that is at least about 90%, or 91%, or 92%, or 93%, or 94%, or 95%, or 96%, or 97%, or 98%, or 99% identical to, or is identical to, a VHH sequence disclosed in Table 6f. In some embodiments, the VHH comprises a CDR-1 region, a CDR-2 region, and a CDR-3 region of a VHH sequence in Table 6f. In some embodiments, the scFv that comprises VH and VL regions comprising amino acid sequences that are at least about 90%, or 91%, or 92%, or 93%, or 94%, or 95%, or 96%, or 97%, or 98%, or 99% identical to, or are identical to, paired VL and VH sequences of an anti-PSMA antibody identified in Table 6g. In some embodiments, the scFv comprises a CDR-H1 region, a CDR-H2 region, a CDR-H3 region, a CDR-L1 region, a CDR-L2 region, and a CDR-L3 region of paired VL and VH sequences of an anti-PSMA antibody identified in Table 6g.

In some embodiments, a paTCE comprises a first binding domain that is an scFv and a second binding domain that is also an scFv. In some embodiments, the scFvs comprise VL and VH domains that are derived from monoclonal antibodies with binding specificity to the tumor-specific marker or an antigen of a cancer cell and effector cell antigen, respectively. In some embodiments, the first and second binding domains each comprise six CDRs derived from monoclonal antibodies with binding specificity to a cancer cell marker, such as a tumor-specific marker and effector cell antigens, respectively. In some embodiments, the first and second binding domains of the first portion of the subject compositions can have 3, 4, 5, or 6 CDRs within each binding domain. In some embodiments, a paTCE comprises a first binding domain and a second binding domain wherein each comprises a CDR-H1 region, a CDR-H2 region, a CDR-H3 region, a CDR-L1 region, a CDR-L2 region, and a CDR-L3 region, wherein each of the regions is derived from a monoclonal antibody capable of binding a tumor-specific marker or an antigen of a cancer cell, and an effector cell antigen, respectively.

In some embodiments, the second binding domain comprises VH and VL regions derived from a monoclonal antibody capable of binding human CD3. In some embodiments, the second binding domain comprises a scFv that comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody identified in Table 6a. In some embodiments, the second domain comprises a CDR-H1 region, a CDR-H2 region, a CDR-H3 region, a CDR-L1 region, a CDR-L2 region, and a CDR-L3 region, wherein each of the regions is derived from a monoclonal antibody identified herein as the antibodies set forth in Table 6a. In some embodiments, the VH and/or VL domains can be configured as scFvs or diabodies.

In some embodiments, a paTCE comprises a first binding domain that is a diabody and a second binding domain that is also a diabody. In some embodiments, the diabodies comprise VL and VH domains that are derived from monoclonal antibodies with binding specificity to the tumor-specific marker or an antigen of a cancer cell and the effector cell antigen, respectively.

In some embodiments, the present disclosure provides a paTCE composition, wherein the diabody second binding domain comprises VH and VL regions wherein each of the VH and VL regions exhibits at least about 90%, or 91%, or 92%, or 93%, or 94%, or 95%, or 96%, or 97%, or 98%, or 99% identity to or is identical to the VL and a VH sequence of the huUCHT1 antibody of Table 6a. In some embodiments, the diabody second domain of the composition is derived from an anti-CD3 antibody described herein. In some embodiments, the anti-CD3 diabody is linked to an anti-PSMA-binding VHH sequence disclosed herein.

Methods to measure binding affinity and/or other biologic activity of an antigen binding domain can be those disclosed herein or methods generally known in the art. For example, the binding affinity of a binding pair (e.g., antibody and antigen), denoted as $K_D$, can be determined using various suitable assays including, but not limited to, radioactive binding assays, non-radioactive binding assays such as fluorescence resonance energy transfer and surface plasmon resonance (SPR, Biacore), and enzyme-linked immunosorbent assays (ELISA), kinetic exclusion assay (KinExA®) or as described in the Examples. An increase or decrease in binding affinity, for example the increased binding affinity of a TCE that has been cleaved to remove a masking moiety compared to the paTCE with the masking moiety attached, can be determined by measuring the binding affinity of the TCE to its target binding partner with and without the masking moiety.

Measurement of half-life of a subject chimeric assembly can be performed by various suitable methods. For example, the half-life of a substance can be determined by administering the substance to a subject and periodically sampling a biological sample (e.g., biological fluid such as blood or plasma or ascites) to determine the concentration and/or amount of that substance in the sample over time. The concentration of a substance in a biological sample can be determined using various suitable methods, including enzyme-linked immunosorbent assays (ELISA), immunoblots, and chromatography techniques including high-pressure liquid chromatography and fast protein liquid chromatography. In some cases, the substance may be labeled with a detectable tag, such as a radioactive tag or a fluorescence tag, which can be used to determine the concentration of the substance in the sample (e.g., a blood sample or a plasma sample. The various pharmacokinetic parameters are then determined from the results, which can be done using software packages such as SoftMax Pro software, or by manual calculations known in the art.

In addition, the physicochemical properties of the paTCE compositions may be measured to ascertain the degree of solubility, structure, and retention of stability. Assays of the subject compositions are conducted that allow determination of binding characteristics of the binding domains towards a ligand, including affinity and binding constants ($K_D$, $k_{on}$ and $k_{off}$), the half-life of dissociation of the ligand-receptor complex, as well as the activity of the binding domain to inhibit the biologic activity of the sequestered ligand compared to free ligand ($IC_{50}$ values). The term "$EC_{50}$" refers to the concentration needed to achieve half of the maximum biological response of the active substance, and is generally determined by ELISA or cell-based assays, including the methods of the Examples described herein.

Anti-CD3 Binding Domains

Also provided are anti-CD3 antibodies, fragments thereof, and fusion proteins comprising such antibodies and/or fragments.

In some embodiments, the present disclosure provides paTCE compositions comprising a binding domain of a first portion with binding affinity to T cells. In some embodiments, the binding domain comprises VL and VH derived from a monoclonal antibody that binds CD3. In some embodiments, the binding domain comprises VL and VH derived from a monoclonal antibody to CD3 epsilon and/or CD3 delta. In some embodiments, the binding domain comprises VL and VH derived from a monoclonal antibody to CD3 epsilon. In some embodiments, the binding domain comprises VL and VH derived from a monoclonal antibody to CD3 delta. Exemplary, non-limiting examples of VL and VH sequences of monoclonal antibodies to CD3 are presented in Table 6a. In some embodiments, the present disclosure provides a paTCE comprising a binding domain with binding affinity to CD3 comprising anti-CD3 VL and VH sequences set forth in Table 6a. In some embodiments, the present disclosure provides a paTCE comprising a binding domain of the first portion with binding affinity to CD3epsilon comprising anti-CD3epsilon VL and VH sequences set forth in Table 6a. In some embodiments, the present disclosure provides a paTCE composition, wherein a binding domain of the first portion comprises an scFv that comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 6a. In some embodiments, the present disclosure provides a paTCE composition comprising a binding domain with binding affinity to CD3 comprising the CDR-L1 region, the CDR-L2 region, the CDR-L3 region, the CDR-H1 region, the CDR-H2 region, and the CDR-H3 region, wherein each is derived from the respective anti-CD3 VL and VH sequences set forth in Table 6a. In some embodiments, the present disclosure provides a paTCE composition comprising a binding domain with binding affinity to CD3 comprising an CDR-L1 region of RSSNGAVTSSNYAN (SEQ ID NO: 1), an CDR-L2 region of GTNKRAP (SEQ ID NO: 4), an CDR-L3 region of ALWYPNLWV (SEQ ID NO: 6), an CDR-H1 region of GFTFSTYAMN (SEQ ID NO: 12), an CDR-H2 region of RIRTKRNNYATYYADSVKG (SEQ ID NO: 13), and an CDR-H3 region of HENFGNSYVSWFAH (SEQ ID NO: 10).

The CD3 complex is a group of cell surface molecules that associates with the T-cell antigen receptor (TCR) and functions in the cell surface expression of TCR and in the signaling transduction cascade that originates when a peptide:MHC ligand binds to the TCR. Without being bound by any scientific theory, typically, when an antigen binds to the T-cell receptor, the CD3 sends signals through the cell membrane to the cytoplasm inside the T cell. This causes activation of the T cell that rapidly divide to produce new T cells sensitized to attack the particular antigen to which the TCR was exposed. The CD3 complex is comprised of the CD3epsilon molecule, along with four other membrane-bound polypeptides (CD3-gamma, -delta, and/or -zeta). In humans, CD3-epsilon is encoded by the CD3E gene on Chromosome 11. The intracellular domains of each of the CD3 chains contain immunoreceptor tyrosine-based activation motifs (ITAMs) that serve as the nucleating point for the intracellular signal transduction machinery upon T cell receptor engagement.

A number of therapeutic strategies modulate T cell immunity by targeting TCR signaling, particularly the anti-human CD3 monoclonal antibodies (mAbs) that are widely used clinically in immunosuppressive regimes. The CD3-specific mouse mAb OKT3 was the first mAb licensed for use in humans (Sgro, C. Side-effects of a monoclonal antibody, muromonab CD3/orthoclone OKT3: bibliographic review. Toxicology 105:23-29, 1995) and is widely used clinically as an immunosuppressive agent in transplantation (Chatenoud, Clin. Transplant 7:422-430, (1993); Chatenoud, Nat. Rev. Immunol. 3:123-132 (2003); Kumar, Transplant. Proc. 30:1351-1352 (1998)), type 1 diabetes, and psoriasis. Importantly, anti-CD3 mAbs can induce partial T cell signaling and clonal anergy (Smith, JA, Nonmitogenic Anti-CD3 Monoclonal Antibodies Deliver a Partial T Cell Receptor Signal and Induce Clonal Anergy J. Exp. Med. 185:1413-1422 (1997)). OKT3 has been described in the literature as a T cell mitogen as well as a potent T cell killer (Wong, JT. The mechanism of anti-CD3 monoclonal antibodies. Mediation of cytolysis by inter-T cell bridging. Transplantation 50:683-689 (1990)). In particular, the studies of Wong demonstrated that by bridging CD3 T cells and target cells, one could achieve killing of the target and that neither FcR-mediated ADCC nor complement fixation was necessary for bivalent anti-CD3 MAB to lyse the target cells.

OKT3 exhibits both a mitogenic and T-cell killing activity in a time-dependent fashion; following early activation of T cells leading to cytokine release, upon further administration OKT3 later blocks all known T-cell functions. It is due to this later blocking of T cell function that OKT3 has found such wide application as an immunosuppressant in therapy regimens for reduction or even abolition of allograft tissue rejection. Other antibodies specific for the CD3 molecule are disclosed in Tunnacliffe, Int. Immunol. 1 (1989), 546-50, WO2005/118635 and WO2007/033230 describe anti-human monoclonal CD3 epsilon antibodies, U.S. Pat. No. 5,821,337 describes the VL and VH sequences of murine anti-D3 monoclonal Ab UCHT1 (muxCD3, Shalaby et al., J. Exp. Med. 175, 217-225 (1992) and a humanized variant of this antibody (hu UCHT1), and United States Patent Application 20120034228 discloses binding domains capable of binding to an epitope of human and non-chimpanzee primate CD3 epsilon chain.

In some embodiments, an anti-CD3 antibody domain comprises a VH region comprising the sequence EVQLVESGGGIVQPGGSLRLSCAASGFTF-STYAMNWVRQAPGKGLEWVGRIRTKRNNYATYY ADSVKGRFTISRDDSKNTVYLQMNSLKTED-TAVYYCVRHENFGNSYVSWFAHWGQGTLVTVS S (SEQ ID NO: 311), or the CDRs thereof, and a VL region comprising the sequence ELVVTQEPSLTVSPGGTVTLT-CRSSNGAVTSSNYANWVQQKPGQAPRGLIGGTNK-RAPGTPA RFSGSLLGGKAALTLSGVQPEDEAVYY-CALWYPNLWVFGGGTKLTVL (SEQ ID NO: 361), or the CDRs thereof.

TABLE 6a

Anti-CD3 Monoclonal Antibodies and Sequences

| Clone Name | Antibody Name | Target | VH Sequence | SEQ ID NO: | VL Sequence | SEQ ID NO: |
|---|---|---|---|---|---|---|
| huOKT3 | | CD3 | QVQLVQSGGG VVQPGRSLRLS CKASGYTFTRY TMHWVRQAPG KGLEWIGYINP SRGYTNYNQK VKDRFTISRDN SKNTAFLQMDS LRPEDTGVYFC ARYYDDHYCLD YWGQGTPVTV SS | 301 | DIQMTQSPSSL SASVGDRVTIT CSASSSVSYM NWYQQTPGKA PKRWIYDTSKL ASGVPSRFSGS GSGTDYTFTIS SLQPEDIATYY CQQWSSNPFT FGQGTKLQITR | 351 |
| huUCHT1 | | CD3 | EVQLVESGGGL VQPGGSLRLSC AASGYSFTGYT MNWVRQAPGK GLEWVALINPY KGVSTYNQKFK DRFTISVDKSK NTAYLQMNSLR AEDTAVYYCAR SGYYGDSDWY FDVWGQGTLV TVSS | 302 | DIQMTQSPSSL SASVGDRVTIT CRASQDIRNYL NWYQQKPGKAP KLLIYY**TSRLE **SGVPSRFSGSG SGTDYTLTISS LQPEDFATYYC QQGNTLPWTF GQGTKVEIK | 352 |
| hu12F6 | | CD3 | QVQLVQSGGG VVQPGRSLRLS | 303 | DIQMTQSPSSL SASVGDRVTMT | 353 |

TABLE 6a-continued

Anti-CD3 Monoclonal Antibodies and Sequences

| Clone Name | Antibody Name | Target | VH Sequence | SEQ ID NO: | VL Sequence | SEQ ID NO: |
|---|---|---|---|---|---|---|
| | | | CKASGYTFTSY TMHWVRQAPG KGLEWIGYINP SSGYTKYNQKF KDRFTISADKS KSTAFLQMDSL RPEDTGVYFCA RWQDYDVYFD YWGQGTPVTV SS | | CRASSSVSYM HWYQQTPGKA PKPWIYATSNL ASGVPSRFSGS GSGTDYTLTISS LQPEDIATYYC QQWSSNPPTF GQGTKLQITR | |
| mOKT3 | | CD3 | QVQLQQSGAE LARPGASVKMS CKASGYTFTRY TMHWVKQRPG QGLEWIGYINP SRGYTNYNQK FKDKATLTTDK SSSTAYMQLSS LTSEDSAVYYC ARYYDDHYCLD YWGQGTTLTV SS | 304 | QIVLTQSPAIMS ASPGEKVTMTC SASSSVSYMN WYQQKSGTSP KRWIYDTSKLA SGVPAHFRGS GSGTSYSLTIS GMEAEDAATYY CQQWSSNPFT FGSGTKLEINR | 354 |
| MT103 | blinatumomab | CD3 | DIKLQQSGAEL ARPGASVKMS CKTSGYTFTRY TMHWVKQRPG QGLEWIGYINP SRGYTNYNQK FKDKATLTTDK SSSTAYMQLSS LTSEDSAVYYC ARYYDDHYCLD YWGQGTTLTV SS | 305 | DIQLTQSPAIMS ASPGEKVTMTC RASSSVSYMN WYQQKSGTSP KRWIYDTSKVA SGVPYRFSGS GSGTSYSLTISS MEAEDAATYYC QQWSSNPLTF GAGTKLELK | 355 |
| MT110 | solitomab | CD3 | DVQLVQSGAEV KKPGASVKVSC KASGYTFTRYT MHWVRQAPGQ GLEWIGYINPS RGYTNYADSVK GRFTITTDKST STAYMELSSLR SEDTATYYCAR YYDDHYCLDY WGQGTTVTVS S | 306 | DIVLTQSPATLS LSPGERATLSC RASQSVSYMN WYQQKPGKAP KRWIYDTSKVA SGVPARFSGS GSGTDYSLTIN SLEAEDAATYY CQQWSSNPLT FGGGTKVEIK | 356 |
| CD3.7 | | CD3 | EVQLVESGGGL VQPGGSLKLSC AASGFTFNKYA MNWVRQAPGK GLEWVARIRSK YNNYATYYADS VKDRFTISRDD SKNTAYLQMNN LKTEDTAVYYC VRHGNFGNSYI SYWAYWGQGT LVTVSS | 307 | QTVVTQEPSLT VSPGGTVTLTC GSSTGAVTSGY YPNWVQQKPG QAPRGLIGGTK FLAPGTPARFS GSLLGGKAALT LSGVQPEDEAE YYCALWYSNR WVFGGGTKLT VL | 357 |
| CD3.8 | | CD3 | EVQLVESGGGL VQPGGSLRLSC AASGFTFNTYA MNWVRQAPGK GLEWVGRIRSK YNNYATYYADS VKGRFTISRDD SKNTLYLQMNS LRAEDTAVYYC VRHGNFGNSY VSWFAYWGQG TLVTVSS | 308 | QAVVTQEPSLT VSPGGTVTLTC GSSTGAVTTSN YANWVQQKPG QAPRGLIGGTN KRAPGVPARFS GSLLGGKAALT LSGAQPEDEAE YYCALWYSNL WVFGGGTKLT VL | 358 |

TABLE 6a-continued

Anti-CD3 Monoclonal Antibodies and Sequences

| Clone Name | Antibody Name | Target | VH Sequence | SEQ ID NO: | VL Sequence | SEQ ID NO: |
|---|---|---|---|---|---|---|
| CD3.9 | | CD3 | EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS | 309 | ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL | 359 |
| CD3.10 | | CD3 | EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS | 310 | QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL | 360 |
| CD3.228 | | CD3 | EVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS | 311 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 361 |
| CD3.23 | | CD3 | EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS | 102 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 101 |
| CD3.24 | | CD3 | EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS | 102 | ELVVTQEPSLTVSPGGTVTLTCRSSNGEVTTSNYANWVQQKPGQAPRGLIGGTIKRAPGTPARFSGSLLGKAALTLSGVQPEDEAVYYCALWYPNLWVFGGGTKLTVL | 103 |
| CD3.30 | | CD3 | EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYC | 105 | ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNL | 104 |

TABLE 6a-continued

Anti-CD3 Monoclonal Antibodies and Sequences

| Clone Name | Antibody Name | Target | VH Sequence | SEQ ID NO: | VL Sequence | SEQ ID NO: |
|---|---|---|---|---|---|---|
| | | | VRHENFGNSYV SWFAHWGQGT LVTVSS | | WVFGGGTKLT VL | |
| CD3.31 | | CD3 | EVQLQESGGGI VQPGGSLKLSC AASGFTFNTYA MNWVRQAPGK GLEWVARIRSK YNNYATYYADS VKDRFTISRDD SKNTVYLQMNN LKTEDTAVYYC VRHENFGNSYV SWFAHWGQGT LVTVSS | 105 | ELVVTQEPSLT VSPGGTVTLTC RSSNGAVTSSN YANWVQQKPG QAPRGLIGGTN KRAPGTPARFS GSLLGGSAALT LSGVQPEDEAV YYCALWYPNL WVFGGGTKLT VL | 106 |
| CD3.32 | | CD3 | EVQLQESGGGI VQPGGSLKLSC AASGFTFNTYA MNWVRQAPGK GLEWVARIRSK YNNYATYYADS VKDRFTISRDD SKNTVYLQMNN LKTEDTAVYYC VRHENFGNSYV SWFAHWGQGT LVTVSS | 105 | ELVVTQEPSLT VSPGGTVTLTC RSSNGAVTSSN YANWVQQKPG QAPRGLIGGTN KRAPGTPARFS GSSLGGSAALT LSGVQPEDEAV YYCALWYPNL WVFGGGTKLT VL | 107 |
| CD3.33 | | CD3 | EVQLQESGGG LVQPGGSLKLS CAASGFTFNTY AMNWVRQAPG KGLEWVARIRS KYNNYATYYAD SVKDRFTISRD DSKNTAYLQMN NLKTEDTAVYY CVRHGNFGNS YVSWFAYWGQ GTLVTVSS | 111 | ELVVTQEPSLT VSPGGTVTLTC RSSTGAVTTSN YANWVQQKPG QAPRGLIGGTN KRAPGTPARFS GSSLGGSAALT LSGVQPEDEAE YYCALWYSNL WVFGGGTKLT VL | 110 |

*underlined sequences, if present, are CDRs within the VL and VH

In some embodiments, the disclosure relates to antigen binding fragments (AF) having specific binding affinity for an effector cell antigen.

Various AF that bind effector cell antigens, particularly CD3 on T cells, have particular utility for pairing with an antigen binding fragment with binding affinity to PSMA antigens associated with a diseased cell or tissue in composition formats in order to recruit and effect effector cell-mediated cell killing of the diseased cell or tissue.

Binding specificity to the antigen of interest can be determined by complementarity determining regions, or CDRs, such as light chain CDRs or heavy chain CDRs. In many cases, binding specificity is determined by light chain CDRs and heavy chain CDRs. A given combination of heavy chain CDRs and light chain CDRs provides a given binding pocket that confers greater affinity and/or specificity towards an effector cell antigen as compared to other reference antigens. The resulting bispecific compositions which on the one hand bind to an effector cell antigen and on the other hand bind to an antigen on the diseased cell or tissue, having a first antigen binding fragment to PSMA linked by a short, flexible peptide linker to a second antigen binding fragment with binding specificity to an effector cell antigen are bispecific, with each antigen binding fragment having specific binding affinity to their respective ligands.

It will be understood that in such compositions, an AF directed against PSMA of a disease tissue is used in combination with an AF directed towards an effector cell marker in order to bring an effector cell in close proximity to the cell of a disease tissue in order to effect the cytolysis of the cell of the diseased tissue. Further, the first antigen fragment (AF1) and the second antigen fragment (AF2) are incorporated into the specifically designed polypeptides comprising cleavable release segments and ELNN segments in order to confer inactive characteristics on the compositions that becomes activated by release of the fused AF1 and AF2 upon the cleavage of the release segments when in proximity to the disease tissue having proteases capable of cleaving the release segments in one or more locations in the release segment sequence.

In some embodiments, the AF2 of the subject compositions has binding affinity for an effector cell antigen expressed on the surface of a T cell. In some embodiments, the AF2 of the subject compositions has binding affinity for CD3. In some embodiments, the AF2 of the subject compositions has binding affinity for a member of the CD3 complex, which includes in individual form or independently combined form all known CD3 subunits of the CD3 complex; for example, CD3 epsilon, CD3 delta, CD3 gamma, and CD3 zeta. In some embodiments, the AF2 has binding affinity for CD3 epsilon, CD3 delta, CD3 gamma, or CD3 zeta.

In some embodiments, the disclosure provides an antigen binding domain (e.g., antibody or an antigen-binding fragment thereof) that binds to cluster of differentiation 3 T cell receptor (CD3), comprising the following CDRs: a VL region CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:9006), wherein X$_1$ corresponds to T or N, and X$_2$ corresponds to T or S; a VL region CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL region CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:9007), wherein X$_4$ corresponds to S or P; a VH region CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:9008), wherein X$_8$ corresponds to S or N; a VH region CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NNYATYYADSVKX$_{12}$ (SEQ ID NO:9009), wherein X$_{10}$ corresponds to T or S, X$_{11}$ corresponds to R or Y, and X$_{12}$ corresponds to G or D; and a VH region CDR3 with an amino acid sequence that has at least 85%, 90%, 91%, 92%, 93%, 94%, 95%, 96%, 97%, 98%, or 99% identity, or 100% identity, to HX$_{15}$NFGNSYVSWFAX$_{16}$ (SEQ ID NO:9010), wherein X$_{15}$ corresponds to E or G, and X$_{16}$ corresponds to H or Y.

In some embodiments, the disclosure provides an antigen binding domain (e.g., antibody or an antigen-binding fragment thereof) that binds to cluster of differentiation 3 T cell receptor (CD3), comprising the following CDRs: a VL region CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1); a VL region CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL region CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6); a VH region CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12); a VH region CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and a VH region CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO:10).

In some embodiments, the antigen binding domain comprises the following FRs: a VL region FR1 with an amino acid sequence that has at least 85%, 90%, 91%, 92%, 93%, 94%, 95%, 96%, 97%, 98%, or 99% identity, or 100% identity, to ELVVTQEPSLTVSPGGTVTLTC (SEQ ID NO:51); a VL region FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52); a VL region FR3 with an amino acid sequence that has at least 85%, 90%, 91%, 92%, 93%, 94%, 95%, 96%, 97%, 98%, or 99% identity, or 100% identity, to GTPARFSGSLLGG-KAALTLSGVQPEDEAVYYC (SEQ ID NO:53); a VL region FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59); a VH region FR1 with an amino acid sequence that has at least 85%, 90%, 91%, 92%, 93%, 94%, 95%, 96%, 97%, 98%, or 99% identity, or 100% identity, to EVQLVES-GGGIVQPGGSLRLSCAAS (SEQ ID NO:400); a VH region FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401); a VH region FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and a VH region FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, the disclosure provides an antigen binding domain (e.g., antibody or an antigen-binding fragment thereof) that binds to CD3, comprising: a VL region comprising three the VL CDRs, wherein the three VL CDRs comprise the CDR1, CDR2, and CDR3 of a VL region comprising the following amino acid sequence: ELVVTQEPSLTVSPGGTVTLTCRSSX$_1$GAVTX$_2$SN-YANWVQQKPGQAPRGLIGGTNKRAPGTP ARFSGSLLGGKAALTLSGVQPEDEAX$_3$YYCA-LWYX$_4$NLWVFGGGTKLTVL, (SEQ ID NO:9001) wherein X$_1$ corresponds to T or N, X$_2$ corresponds to T or S, X$_3$ corresponds to E or V, and X$_4$ corresponds to S or P; and a VH region comprising three VH CDRs, wherein the three VH CDRs comprise the CDR1, CDR2, and CDR3 of a VH region comprising the following amino acid sequence: EVQLX$_5$ESGGGX$_6$VQPGGSLX$_7$LSCAASGFTFX$_8$T-YAMNWVRQAPGKGLEWVX$_9$RIRX$_{10}$KX$_{11}$NN YATYYADSVKX$_{12}$RFTISRDDSKNTX$_{13}$YLQMNX$_{14}$L-KTEDTAVYYCVRHX$_{15}$NFGNSYVSWFAX$_{16}$WGQG-TLVTVSS (SEQ ID NO:9002), wherein X$_5$ corresponds to V or L, X$_6$ corresponds to I or L, X$_7$ corresponds to R or K, X$_8$ corresponds to S or N, X$_9$ corresponds to G or A, X$_{10}$ corresponds to T or S, X$_{11}$ corresponds to R or Y, X$_{12}$ corresponds to G or D, X$_{13}$ corresponds to V or A, X$_{14}$ corresponds to S or N, X$_{15}$ corresponds to E or G, and X$_{16}$ corresponds to H or Y.

In some embodiments, the disclosure provides an antigen binding domain (e.g., antibody or an antigen-binding fragment thereof) that binds to CD3, comprising: a VL region comprising three VL CDRs, wherein the three VL CDRs comprise the CDR1, CDR2, and CDR3 of a VL region comprising the following amino acid sequence: ELVVTQEPSLTVSPGGTVTLTCRSSN-GAVTSSNYANWVQQKPGQAPRGLIGGTNKRAPGTPA RFSGSLLGGKAALTLSGVQPEDEAVYY-CALWYPNLWVFGGGTKLTVL (SEQ ID NO: 361); and a VH region comprising three VH CDRs, wherein the three VH CDRs comprise the CDR1, CDR2, and CDR3 of a VH region comprising the following amino acid sequence:

(SEQ ID NO: 311)
EVQLVESGGGIVQPGGSLRLSCAASGFTFSTYAMNWVRQAPGKGLEWVGR

IRTKRNNYATYYADSVKGRFTISRDDSKNTVYLQMNSLKTEDTAVYYCVR

HENFGNSYVSWFAHWGQGTLVTVSS.

In some embodiments, the disclosure provides an antigen binding domain (e.g., antibody or an antigen-binding fragment thereof) that binds to CD3, comprising a VL region amino acid sequence SEQ ID NO/VH region amino acid sequence SEQ ID NO pair selected from the group consisting of: 896/897; 902/903; 700/701; 702/703; 716/717; 718/719; 728/729; 736/737; 738/739; 740/741; 742/743; 744/745; 746/747; 748/749; 750/751; 752/753; 754/755; 756/757; 758/759; 760/761; 762/763; 764/765; 766/767; 774/775; 776/777; 790/791; 792/793; 798/799; 800/801; 806/807; 808/809; 814/815; 816/817; 822/823; 824/825; or 826/867.

In some embodiments, the present disclosure provides an antigen binding fragment (e.g., AF1 or AF2) that binds to the CD3 protein complex that has enhanced stability compared to CD3 binding antibodies or antigen binding fragments known in the art. In some embodiments, a CD3 antigen binding fragment of the disclosure is designed to confer a higher degree of stability on the chimeric bispecific antigen binding fragment compositions into which they are integrated, leading to improved expression and recovery of the fusion protein, increased shelf-life and enhanced stability when administered to a subject. In some embodiments, an anti-CD3 AF of the present disclosure has a higher degree of thermal stability compared to certain CD3-binding antibodies and antigen binding fragments known in the art. In some embodiments, an anti-CD3 AF of the present disclosure has a higher degree of thermal stability compared to SP34 or an antigen binding fragment thereof. In some embodiments, an anti-CD3 AF of the present disclosure has a higher degree of thermal stability compared to CD3.9 and/or CD3.23 as disclosed in PCT International Patent Application Publication No. WO2021263058, the entire content of which is hereby incorporated herein by reference. In some embodiments, the anti-CD3 AF of the present disclosure is less immunogenic in a human compared to certain CD3-binding antibodies and antigen binding fragments known in the art. In some embodiments, an anti-CD3 AF of the present disclosure is less immunogenic than SP34 or an antigen binding fragment thereof. In some embodiments, an anti-CD3 AF of the present disclosure is less immunogenic than CD3.9 and/or CD3.23 as disclosed in PCT International Patent Application Publication No. WO2021263058, the entire content of which is hereby incorporated herein by reference. In some embodiments, the degree to which an AF is immunogenic is determined by an immunogenicity prediction method such as TEPITOPEpan (described in Zhang et al. PLoS One. 2012; 7(2):e30483. doi: 10.1371/journal.pone.0030483, PMID: 22383964, the entire content of which is incorporated herein by reference) or NetMHCpan-4.1 and NetMHCIIpan-4.0 (each described in Reynisson et al., Nucleic Acids Res 2020; 48(W1):W449-W454. doi: 10.1093/nar/gkaa379., PMID: 32406916, the entire content of which is hereby incorporated herein by reference). In some embodiments, the anti-CD3 AF utilized as components of the chimeric bispecific antigen binding fragment compositions into which they are integrated exhibit favorable pharmaceutical properties, including high thermostability and low aggregation propensity, resulting in improved expression and recovery during manufacturing and storage, as well promoting long serum half-life. Biophysical properties such as thermostability are often limited by the antibody variable domains, which differ greatly in their intrinsic properties. High thermal stability is often associated with high expression levels and other desired properties, including being less susceptible to aggregation (Buchanan A, et al. Engineering a therapeutic IgG molecule to address cysteinylation, aggregation and enhance thermal stability and expression. MAbs 2013; 5:255). In some embodiments, thermal stability is determined by measuring the "melting temperature" ($T_m$), which is defined as the temperature at which half of the molecules are denatured. The melting temperature of each heterodimer is indicative of its thermal stability. In vitro assays to determine $T_m$ are known in the art, including methods described in the Examples, below. The melting point of the heterodimer may be measured using techniques such as differential scanning calorimetry (Chen et al (2003) Pharm Res 20:1952-60; Ghirlando et al (1999) Immunol Lett 68:47-52). Alternatively, the thermal stability of the heterodimer may be measured using circular dichroism (Murray et al. (2002) J. Chromatogr Sci 40:343-9), or as described in the Examples, below.

In some embodiments of the polypeptides of this disclosure, the antigen binding fragment (e.g., AF1 or AF2) can exhibit a higher thermal stability than an anti-CD3 binding fragment consisting of a sequence of SEQ ID NO: 206 (see Table 6e), as evidenced in an in vitro assay by a higher melting temperature ($T_m$) of the first antigen binding fragment relative to that of the anti-CD3 binding fragment; or upon incorporating the first antigen binding fragment into a test bispecific antigen binding domain, a higher $T_m$ of the test bispecific antigen binding domain relative to that of a control bispecific antigen binding domain, wherein the test bispecific antigen binding domain comprises the first antigen binding fragment and a reference antigen binding fragment that binds to an antigen other than CD3; and wherein the control bispecific antigen binding domain consists of the anti-CD3 binding fragment consisting of the sequence of SEQ ID NO:206 (see Table 6e) and the reference antigen binding fragment. In some embodiments, the melting temperature ($T_m$) of the first antigen binding fragment can be at least 2° C. greater, or at least 3° C. greater, or at least 4° C. greater, or at least 5° C. greater than the $T_m$ of the anti-CD3 binding fragment consisting of the sequence of SEQ ID NO: 206 (see Table 6e).

In some embodiments, the polypeptides of any of the subject composition embodiments described herein comprise an antigen binding fragment (AF) that specifically bind human CD3. The antigen binding fragment (AF) can specifically bind human CD3. In some embodiments, the antigen binding fragment (AF) can bind a CD3 complex subunit identified herein as CD3 epsilon, CD3 delta, CD3 gamma, or CD3 zeta unit of CD3. The antigen binding fragment (AF) can bind a CD3 epsilon fragment of CD3. In some embodiments, the antigen binding fragment (AF) can specifically bind human CD3 with a binding affinity ($K_D$) constant between about 10 nM and about 400 nM, or between about 50 nM and about 350 nM, or between about 100 nM and 300 nM, as determined in an in vitro antigen-binding assay comprising a human CD3 antigen. In some embodiments, the polypeptides of any of the subject composition embodiments described herein comprise an antigen binding fragment (AF) that specifically binds human CD3 with a binding affinity ($K_D$) weaker than about 10 nM, or about 50 nM, or about 100 nM, or about 150 nM, or about 200 nM, or about 250 nM, or about 300 nM, or about 350 nM, or weaker than about 400 nM as determined in an in vitro antigen-binding assay. For clarity, an antigen binding fragment (AF) with a $K_D$ of 400 binds its ligand more weakly than one with a $K_D$ of 10 nM. In some embodiments, the polypeptides of any of the subject composition embodiments described herein comprise an antigen binding fragment (AF) that specifically binds human CD3 with at least 2-fold, 3-fold, 4-fold, 5-fold, 6-fold, 7-fold, 8-fold, 9-fold, or at least 10-fold weaker binding affinity than an antigen binding fragment consisting of an amino acid sequence of Table 6f-h, as determined by the respective binding affinities ($K_D$) in an in vitro antigen-binding assay.

In some embodiments, the present disclosure provides bispecific polypeptides comprising an antigen binding fragment (AF) that exhibits a binding affinity to CD3 (anti-CD3 AF) that is at least 2-fold, 3-fold, 4-fold, 5-fold, 6-fold, 7-fold, 8-fold, 9-fold, 10-fold, 20-fold, 50-fold, 100-fold, or at least 1000-fold at weaker relative to that of an anti-PSMA AF embodiments described herein that are incorporated into the subject polypeptides, as determined by the respective binding affinities ($K_D$) in an in vitro antigen-binding assay.

The binding affinity of the subject compositions for the target ligands can be assayed, e.g., using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19)12):487, or other methods known in the art.

In some embodiments, the present disclosure provides an antigen binding fragment (AF) that binds to CD3 (anti-CD3 AF) and is incorporated into a chimeric, bispecific polypeptide composition that is designed to have an isoelectric point (pI) that confers enhanced stability on the composition compared to corresponding compositions comprising CD3 binding antibodies or antigen binding fragments known in the art. In some embodiments, the polypeptides of any of the subject composition embodiments described herein comprise AF that bind to CD3 (anti-CD3 AF) wherein the anti-CD3 AF exhibits a pI that is between 6.0 and 6.6, inclusive. In some embodiments, the polypeptides of any of the subject composition embodiments described herein comprise AF that bind to CD3 (anti-CD3 AF) wherein the anti-CD3 AF exhibits a pI that is at least 0.1, 0.2, 0.3, 0.4, 0.5, 0.6, 0.7, 0.8, 0.9, or 1.0 pH unit lower than the pI of a reference antigen binding fragment (e.g., consisting of a sequence shown in SEQ ID NO: 206 (see Table 6e)). In some embodiments, the polypeptides of any of the subject composition embodiments described herein comprise an AF that binds to CD3 (anti-CD3 AF) fused to another AF that binds to a PSMA antigen (anti-PSMA AF) wherein the anti-CD3 AF exhibits a pI that is within at least 0.1, 0.2, 0.3, 0.4, 0.5, 0.6, 0.7, 0.8, 0.9, 1.0, 1.1, 1.2, 1.3, 1.4, or 1.5 pH units of the pI of the AF that binds PSMA antigen or an epitope thereof. In some embodiments, the polypeptides of any of the subject composition embodiments described herein comprise an AF that binds to CD3 (anti-CD3 AF) fused to an AF that binds to a PSMA antigen (anti-PSMA AF) wherein the AF exhibits a pI that is within at least about 0.1 to about 1.5, or at least about 0.3 to about 1.2, or at least about 0.5 to about 1.0, or at least about 0.7 to about 0.9 pH units of the pI of the anti-CD3 AF. It is specifically intended that by such design wherein the pI of the two antigen binding fragments are within such ranges, the resulting fused antigen binding fragments will confer a higher degree of stability on the chimeric bispecific antigen binding fragment compositions into which they are integrated, leading to improved expression and enhanced recovery of the fusion protein in soluble, non-aggregated form, increased shelf-life of the formulated chimeric bispecific polypeptide compositions, and enhanced stability when the composition is administered to a subject. In some embodiments, having the two AFs (the anti-CD3 AF and the anti-PSMA AF) within a relatively narrow pI range of may allow for the selection of a buffer or other solution in which both the AFs (anti-CD3 AF and anti-PSMA AF) are stable, thereby promoting overall stability of the composition. In some embodiments, the antigen binding fragment (AF) can exhibit an isoelectric point (pI) that is less than or equal to 6.6. In some embodiments, the antigen binding fragment (AF) can exhibit an isoelectric point (pI) that is between 6.0 and 6.6, inclusive. In some embodiments, the antigen binding fragment (AF) can exhibit an isoelectric point (pI) that is at least 0.1, 0.2, 0.3, 0.4, 0.5, 0.6, 0.7, 0.8, 0.9, or 1.0 pH units lower than the pI of a reference antigen binding fragment consisting of a sequence shown in SEQ ID NO: 206 (see Table 6e). In some embodiments, the antigen binding fragment (AF) can specifically bind human CD3 with a binding affinity ($K_D$) constant between about between about 10 nM and about 400 nM (such as determined in an in vitro antigen-binding assay comprising a human CD3 antigen). In some embodiments, the antigen binding fragment (AF) can specifically bind human CD3 with a binding affinity ($K_D$) of less than about 10 nM, or less than about 50 nM, or less than about 100 nM, or less than about 150 nM, or less than about 200 nM, or less than about 250 nM, or less than about 300 nM, or less than about 350 nM, or less than about 400 nM (such as determined in an in vitro antigen-binding assay). In some embodiments, the antigen binding fragment (AF) can exhibit a binding affinity to CD3 that is at least 2-fold, 3-fold, 4-fold, 5-fold, 6-fold, 7-fold, 8-fold, 9-fold, or at least 10-fold weaker relative to that of an antigen binding fragment consisting of an amino acid sequence of SEQ ID NO: 206 (see Table 6e) (such as determined by the respective binding affinities ($K_D$) in an in vitro antigen-binding assay).

In some embodiments, the VL and VH of the antigen binding fragments are fused by relatively long linkers, consisting of 25, 26, 27, 28, 29, 30, 31, 32, 33, 34, or 35 hydrophilic amino acids that, when joined together, have a flexible characteristic. In some embodiments, the VL and VH of any of the scFv embodiments described herein are linked by a relatively long linker having the sequence SESATPESGPGTSPGATPESGPGTSESATP (SEQ ID NO: 81). In some embodiments, the VL and VH of any of the scFv embodiments described herein are linked by relatively long linkers of hydrophilic amino acids having the sequences GSGEGSEGEGGGEGSEGEGSGEGGEGEGSG (SEQ ID NO: 82), TGSGEGSEGEGGGEGSEGEGSGEGGEGEGSGT (SEQ ID NO: 83), GATPPETGAETESPGETTGGSAESEPPGEG (SEQ ID NO: 84), or GSAAPTAGTTPSASPAPPTGGS-SAAGSPST (SEQ ID NO: 85). In some embodiments, the AF1 and AF2 are linked together by a short linker of hydrophilic amino acids having 3, 4, 5, 6, or 7 amino acids. In some embodiments, the short linker sequences are identified herein as the sequences SGGGGS (SEQ ID NO: 86), GGGGS (SEQ ID NO: 87), GGSGGS (SEQ ID NO: 88), GGS, or GSP. In some embodiments, the disclosure provides compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by one of the foregoing short linkers and the second and the third variable domains are fused by one of the foregoing relatively long linkers. In some embodiments, the selection of the short linker and relatively long linker is to prevent the incorrect pairing of adjacent variable domains, thereby facilitating the formation of a single chain configuration comprising the VL and VH of the first antigen binding fragment and the second antigen binding fragment.

TABLE 6b

Exemplary CD3 CDR Sequences

| Antibody Domain | CDR REGION | Amino Acid Sequence | SEQ ID NO: |
|---|---|---|---|
| 3.23, 3.30, 3.31, 3.32, 3.228 | CDR-L1 | RSSNGAVTSSNYAN | 1 |
| 3.24 | CDR-L1 | RSSNGEVTTSNYAN | 2 |
| 3.33, 3.9 | CDR-L1 | RSSTGAVTTSNYAN | 3 |
| 3.23, 3.30, 3.31, 3.32, 3.9, 3.33, 3.228 | CDR-L2 | GTNKRAP | 4 |
| 3.24 | CDR-L2 | GTIKRAP | 5 |
| 3.23, 3.24, 3.30, 3.31, 3.32, 3.228 | CDR-L3 | ALWYPNLWV | 6 |
| 3.33, 3.9 | CDR-L3 | ALWYSNLWV | 7 |
| 3.23, 3.24, 3.30, 3.31, 3.32, 3.9, 3.33 | CDR-H1 | GFTFNTYAMN | 8 |
| 3.228 | CDR-H1 | GFTFSTYAMN | 12 |
| 3.23, 3.24, 3.30, 3.31, 3.32, 3.9, 3.33 | CDR-H2 | RIRSKYNNYATYYADSVKD | 9 |
| 3.228 | CDR-H2 | RIRTKRNNYATYYADSVKG | 13 |
| 3.23. 3.24, 3.30, 3.31, 3.32, 3.228 | CDR-H3 | HENFGNSYVSWFAH | 10 |
| 3.9, 3.33 | CDR-H3 | HGNFGNSYVSWFAY | 11 |

TABLE 6c

Exemplary CD3 FR Sequences

| Antibody Domain | FR REGION | Amino Acid Sequence | SEQ ID NO: |
|---|---|---|---|
| 3.23, 3.24, 3.30, 3.31, 3.32, 3.9, 3.33, 3.228 | FR-L1 | ELVVTQEPSLTVSPGGTVTLTC | 51 |
| 3.23, 3.24, 3.30, 3.31, 3.32, 3.9, 3.33, 3.228 | FR-L2 | WVQQKPGQAPRGLIG | 52 |
| 3.23, 3.24, 3.228 | FR-L3 | GTPARFSGSLLGGKAALTLSGVQPEDEAVYYC | 53 |
| 3.30 | FR-L3 | GTPARFSGSSLGGKAALTLSGVQPEDEAVYYC | 54 |
| 3.31 | FR-L3 | GTPARFSGSLLGGSAALTLSGVQPEDEAVYYC | 55 |
| 3.32 | FR-L3 | GTPARFSGSSLGGSAALTLSGVQPEDEAVYYC | 56 |
| 3.9 | FR-L3 | GTPARFSGSLLGGKAALTLSGVQPEDEAYYYC | 57 |
| 3.33 | FR-L3 | GTPARFSGSSLGGSAALTLSGVQPEDEAYYYC | 58 |
| 3.23, 3.24, 3.30, 3.31, 3.32, 3.9, 3.33, 3.228 | FR-L4 | FGGGTKLTVL | 59 |
| 3.228 | FR-H1 | EVQLVESGGGIVQPGGSLRLSCAAS | 400 |
| 3.23, 3.24 | FR-H1 | EVQLLESGGGIVQPGGSLKLSCAAS | 60 |
| 3.30, 3.31, 3.32 | FR-H1 | EVQLQESGGGIVQPGGSLKLSCAAS | 61 |
| 3.33 | FR-H1 | EVQLQESGGGLVQPGGSLKLSCAAS | 62 |

TABLE 6c-continued

Exemplary CD3 FR Sequences

| Antibody Domain | FR REGION | Amino Acid Sequence | SEQ ID NO: |
|---|---|---|---|
| 3.9 | FR-H1 | EVQLLESGGGLVQPGGSLKLSCAAS | 63 |
| 3.23, 3.24, 3.30, 3.31, 3.32, 3.9, 3.33 | FR-H2 | WVRQAPGKGLEWVA | 64 |
| 3.228 | FR-H2 | WVRQAPGKGLEWVG | 401 |
| 3.23, 3.24, 3.30, 3.31, 3.32 | FR-H3 | RFTISRDDSKNTVYLQMNNLKTEDTAVYYCVR | 65 |
| 3.9, 3.33 | FR-H3 | RFTISRDDSKNTAYLQMNNLKTEDTAVYYCVR | 66 |
| 3.228 | FR-H3 | RFTISRDDSKNTVYLQMNSLKTEDTAVYYCVR | 402 |
| 3.23, 3.24, 3.30, 3.31, 3.32, 3.9, 3.33, 3.228 | FR-H4 | WGQGTLVTVSS | 67 |

TABLE 6d

Exemplary CD3 VL & VH Sequences

| Antibody Domain | REGION | Amino Acid Sequence | SEQ ID NO: |
|---|---|---|---|
| 3.23 | VL | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 101 |
| 3.23, 3.24 | VH | EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS | 102 |
| 3.24 | VL | ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVL | 103 |
| 3.30 | VL | ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVL | 104 |
| 3.30, 3.31, 3.32 | VH | EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS | 105 |
| 3.31 | VL | ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVL | 106 |
| 3.32 | VL | ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVL | 107 |
| 3.9 | VL | ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL | 108 |
| 3.9 | VH | EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS | 109 |

TABLE 6d-continued

Exemplary CD3 VL & VH Sequences

| Antibody Domain | REGION | Amino Acid Sequence | SEQ ID NO: |
| --- | --- | --- | --- |
| 3.33 | VL | ELVVTQEPSLTVSPGGTVTLTCRSSTGAVTTSNYA NWVQQKPGQAPRGLIGGTNKRAPGTPARFSGSSL GGSAALTLSGVQPEDEAEYYCALWYSNLWVFGG GTKLTVL | 110 |
| 3.33 | VH | EVQLQESGGGLVQPGGSLKLSCAASGFTFNTYAM NWVRQAPGKGLEWVARIRSKYNNYATYYADSVKD RFTISRDDSKNTAYLQMNNLKTEDTAVYYCVRHGN FGNSYVSWFAYWGQGTLVTVSS | 111 |
| 3.228 | VL | ELVVTQEPSLTVSPGGTVTLTCRSSNGAVTSSNYA NWVQQKPGQAPRGLIGGTNKRAPGTPARFSGSLL GGKAALTLSGVQPEDEAVYYCALWYPNLWVFGG GTKLTVL | 361 |
| 3.228 | VH | EVQLVESGGGIVQPGGSLRLSCAASGFTFSTYAM NWVRQAPGKGLEWVGRIRTKRNNYATYYADSVK GRFTISRDDSKNTVYLQMNSLKTEDTAVYYCVRHE NFGNSYVSWFAHWGQGTLVTVSS | 311 |

TABLE 6e

Exemplary CD3 scFv Sequences

| Antibody Domain | Amino Acid Sequence | SEQ ID NO: |
| --- | --- | --- |
| 3.23 | ELVVTQEPSLTVSPGGTVTLTCRSSNGAVTSSNYANWVQQKPGQ APRGLIGGTNKRAPGTPARFSGSLLGGKAALTLSGVQPEDEAVYY CALWYPNLWVFGGGTKLTVLGATPPETGAETESPGETTGGSAES EPPGEGEVQLLESGGGIVQPGGSLKLSCAASGFTFNTYAMNWVR QAPGKGLEWVARIRSKYNNYATYYADSVKDRFTISRDDSKNTVYL QMNNLKTEDTAVYYCVRHENFGNSYVSWFAHWGQGTLVTVSS | 201 |
| 3.24 | ELVVTQEPSLTVSPGGTVTLTCRSSNGEVTTSNYANWVQQKPGQ APRGLIGGTIKRAPGTPARFSGSLLGGKAALTLSGVQPEDEAVYYC ALWYPNLWVFGGGTKLTVLGATPPETGAETESPGETTGGSAESE PPGEGEVQLLESGGGIVQPGGSLKLSCAASGFTFNTYAMNWVRQ APGKGLEWVARIRSKYNNYATYYADSVKDRFTISRDDSKNTVYLQ MNNLKTEDTAVYYCVRHENFGNSYVSWFAHWGQGTLVTVSS | 202 |
| 3.30 | ELVVTQEPSLTVSPGGTVTLTCRSSNGAVTSSNYANWVQQKPGQ APRGLIGGTNKRAPGTPARFSGSSLGGKAALTLSGVQPEDEAVYY CALWYPNLWVFGGGTKLTVLGATPPETGAETESPGETTGGSAES EPPGEGEVQLQESGGGIVQPGGSLKLSCAASGFTFNTYAMNWVR QAPGKGLEWVARIRSKYNNYATYYADSVKDRFTISRDDSKNTVYL QMNNLKTEDTAVYYCVRHENFGNSYVSWFAHWGQGTLVTVSS | 203 |
| 3.31 | ELVVTQEPSLTVSPGGTVTLTCRSSNGAVTSSNYANWVQQKPGQ APRGLIGGTNKRAPGTPARFSGSLLGGSAALTLSGVQPEDEAVYY CALWYPNLWVFGGGTKLTVLGATPPETGAETESPGETTGGSAES EPPGEGEVQLQESGGGIVQPGGSLKLSCAASGFTFNTYAMNWVR QAPGKGLEWVARIRSKYNNYATYYADSVKDRFTISRDDSKNTVYL QMNNLKTEDTAVYYCVRHENFGNSYVSWFAHWGQGTLVTVSS | 204 |
| 3.32 | ELVVTQEPSLTVSPGGTVTLTCRSSNGAVTSSNYANWVQQKPGQ APRGLIGGTNKRAPGTPARFSGSSLGGSAALTLSGVQPEDEAVYY CALWYPNLWVFGGGTKLTVLGATPPETGAETESPGETTGGSAES EPPGEGEVQLQESGGGIVQPGGSLKLSCAASGFTFNTYAMNWVR QAPGKGLEWVARIRSKYNNYATYYADSVKDRFTISRDDSKNTVYL QMNNLKTEDTAVYYCVRHENFGNSYVSWFAHWGQGTLVTVSS | 205 |
| 3.9 | ELVVTQEPSLTVSPGGTVTLTCRSSTGAVTTSNYANWVQQKPGQ APRGLIGGTNKRAPGTPARFSGSLLGGKAALTLSGVQPEDEAEYY CALWYSNLWVFGGGTKLTVLGATPPETGAETESPGETTGGSAES EPPGEGEVQLLESGGGLVQPGGSLKLSCAASGFTFNTYAMNWVR QAPGKGLEWVARIRSKYNNYATYYADSVKDRFTISRDDSKNTAYL QMNNLKTEDTAVYYCVRHGNFGNSYVSWFAYWGQGTLVTVSS | 206 |

TABLE 6e-continued

Exemplary CD3 scFv Sequences

| Antibody Domain | Amino Acid Sequence | SEQ ID NO: |
|---|---|---|
| 3.33 | ELVVTQEPSLTVSPGGTVTLTCRSSTGAVTTSNYANWVQQKPGQ APRGLIGGTNKRAPGTPARFSGSSLGGSAALTLSGVQPEDEAEYY CALWYSNLWVFGGGTKLTVLGATPPETGAETESPGETTGGSAES EPPGEGEVQLQESGGGLVQPGGSLKLSCAASGFTFNTYAMNWVR QAPGKGLEWVARIRSKYNNYATYYADSVKDRFTISRDDSKNTAYL QMNNLKTEDTAVYYCVRHGNFGNSYVSWFAYWGQGTLVTVSS | 207 |
| 4.11 | QSVLTQPPSASGTPGQRVTISCSGSSSNIGSNYVYWYQQLPGTAP KLLIYRNNQRPSGVPDRFSGSKSGTSASLAISGLRSEDEADYYCAA WDDSLSGLWVFGGGTKLTVLGATPPETGAETESPGETTGGSAES EPPGEGQVQLQQWGGGLVKPGGSLRLSCAASGFTFSSYSMNWV RQAPGKGLEWVSRINSDGSSTNYADSVKGRFTISRDNAKNTLYLQ MNSLRAEDTAVYYCARELRWGNWGQGTLVTVSS | 208 |
| 4.12 | QAGLTQPPSASGTPGQRVTLSCSGSYSNIGTYYVYWYQQLPGTA PKLLIYSNDQRLSGVPDRFSGSKSGTSASLAISGLQSEDEAAYYCA AWDDSLNGWAFGGGTKLTVLGATPPETGAETESPGETTGGSAES EPPGEGQVQLQQWGGGLVKPGGSLRLSCAASGFTFSSYSMNWV RQAPGKGLEWVSRINSDGSSTNYADSVKGRFTISRDNAKNTLYLQ MNSLRAEDTAVYYCARELRWGNWGQGTLVTVSS | 209 |
| 4.13 | QPGLTQPPSASGTPGQRVTLSCSGRSSNIGSYYVYWYQHLPGMA PKLLIYRNSRRPSGVPDRFSGSKSGTSASLVISGLQSDDEADYYCA AWDDSLKSWVFGGGTKLTVLGATPPETGAETESPGETTGGSAES EPPGEGQVQLQQWGGGLVKPGGSLRLSCAASGFTFSSYSMNWV RQAPGKGLEWVSRINSDGSSTNYADSVKGRFTISRDNAKNTLYLQ MNSLRAEDTAVYYCARELRWGNWGQGTLVTVSS | 210 |
| 4.14 | QSVLTQPPSASGTPGQRVTISCSGSSSNIGTNYVYWYQQFPGTAP KLLIYSNNQRPSGVPDRFSGSKSGTSGSLAISGLQSEDEADYSCAA WDDSLNGWVFGGGTKLTVLGATPPETGAETESPGETTGGSAESE PPGEGQVQLVQWGGGLVKPGGSLRLSCAASGFTFSSYSMNWVR QAPGKGLEWVSRINSDGSSTNYADSVKGRFTISRDNAKNTLYLQM NSLRAEDTAVYYCARELRWGNWGQGTLVTVSS | 211 |
| 4.15 | QPGLTQPPSASGTPGQRVTISCSGSSSNIGSNYVYWYQQLPGTAP KLLIYRNNQRPSGVPDRLSGSKSGTSASLAISGLRSEDEADYYCAA WDDSLSGWVFGGGTKLTVLGATPPETGAETESPGETTGGSAESE PPGEGQVQLVQWGGGLVKPGGSLRLSCAASGFTFSSYSMNWVR QAPGKGLEWVSRINSDGSSTNYADSVKGRFTISRDNAKNTLYLQM NSLRAEDTAVYYCARELRWGNWGQGTLVTVSS | 212 |
| 4.16 | QAVLTQPPSASGTPGQRVTISCSGSSSNIGSYYVYWYQQVPGAAP KLLMRLNNQRPSGVPDRFSGAKSGTSASLVISGLRSEDEADYYCA AWDDSLSGQWVFGGGTKLTVLGATPPETGAETESPGETTGGSAE SEPPGEGQVQLQQWGGGLVKPGGSLRLSCAASGFTFSSYSMNW VRQAPGKGLEWVSRINSDGSSTNYADSVKGRFTISRDNAKNTLYL QMNSLRAEDTAVYYCARELRWGNWGQGTLVTVSS | 213 |
| 4.17 | QAGLTQPPSASGTPGQRVTISCSGSSSNIGSNYVYWYQQLPGTAP KLLIYRNNQRPSGVPDRFSGSKSGTSASLAISGLRSEDEADYYCAT WDASLSGWVFGGGTKLTVLGATPPETGAETESPGETTGGSAESE PPGEGEVQLVQWGGGLVKPGGSLRLSCAASGFTFSSYSMNWVR QAPGKGLEWVSRINSDGSSTNYADSVKGRFTISRDNAKNTLYLQM NSLRAEDTAVYYCARELRWGNWGQGTLVTVSS | 214 |
| 3.228 | ELVVTQEPSLTVSPGGTVTLTCRSSNGAVTSSNYANWVQQKPGQ APRGLIGGTNKRAPGTPARFSGSLLGGKAALTLSGVQPEDEAVYY CALWYPNLWVFGGGTKLTVL SESATPESGPGTSPGATPESGPGTSESATPEVQLVESGGGIVQPG GSLRLSCAASGFTFSTYAMNWVRQAPGKGLEWVGRIRTKRNNYA TYYADSVKGRFTISRDDSKNTVYLQMNSLKTEDTAVYYCVRHENF GNSYVSWFAHWGQGTLVTVSS | 215 |

Anti-PSMA Binding Domains

Also provided are anti-PSMA antibodies, fragments thereof, and fusion proteins comprising such antibodies and/or fragments.

In some embodiments, the present disclosure provides paTCE compositions comprising a first portion binding domain that binds to the tumor-specific marker PSMA and a second binding domain that binds to an effector cell antigen, such as CD3 antigen.

In some embodiments, the first portion binding domain is a VHH domain. Non-limiting examples of VHH domain sequences are provided in Table 6f. In some embodiments, the binding domain with binding affinity for the tumor-specific marker PSMA is a VHH domain, listed in Table 6f.

In some embodiments, the binding domain with binding affinity for PSMA is a VHH domain comprising three CDRs from a VHH domain listed in Table 6f.

In some embodiments, the present disclosure provides a paTCE composition comprising a first portion binding domain with binding affinity to the tumor-specific marker PSMA comprising anti-PSMA VHH sequences set forth in Table 6f. In some embodiments, the binding has a $K_D$ value of about $10^{-10}$ to $10^{-7}$ M, as determined in an in vitro binding assay. In some embodiments, the binding has a $K_D$ value of about 44 nM, as determined in an in vitro binding assay. It is specifically contemplated that the paTCE composition can comprise any one of the binding domains disclosed herein or sequence variants thereof so long as the variants exhibit binding specificity for the described antigen.

TABLE 6f

Anti-PSMA VHH Sequences

| Antibody Name | AC Number | VHH Sequence | SEQ ID NO: |
|---|---|---|---|
| PSMA.301 | AC3703 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCAASNKLYGR TWYDFNESDYWGQGTQVTVSS | 500 |
| PSMA.302 | AC3704 | QVQLVESGGGVVQPGRSLRLSCAASG RTFGIYVWGWFRQAPGKEREFVGAIS WSGSNRKVSDSVKGRFTISRDNSKNT LYLQMNSLRAEDTAVYFCAASNKLYGR TWYDFNESDYWGQGTQVTVSS | 501 |
| PSMA.303 | AC3705 | QVQLVESGGGVVQPGRSLRLSCAASG RTFGIYVMGWFRQAPGKEREFVGAMS WSGSNRKVSDSVKGRFTISRDNSKNT LYLQMNSLRAEDTAVYFCAASNKLYGR TWYDFNESDYWGQGTQVTVSS | 502 |
| PSMA.304 | AC3706 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCAASNKLYGR TWYDFNESDYWGQGTQVTVSS | 503 |
| PSMA.305 | AC3707 | QVQLVESGGGVVQPGRSLRLSCAASG RTFGIYVWGWFRQAPGKEREFVGAIS WSGSNRKVSDSVKGRFTISRDNSKNT LYLQMNSLRAEDTAVYYCAASNKLYG RTWYDFNESDYWGQGTQVTVSS | 504 |
| PSMA.306 | AC3708 | QVQLVESGGGVVQPGRSLRLSCAASG RTFGIYVMGWFRQAPGKEREFVGAMS WSGSNRKVSDSVKGRFTISRDNSKNT LYLQMNSLRAEDTAVYYCAASNKLYG RTWYDFNESDYWGQGTQVTVSS | 505 |
| PSMA.307 | AC3709 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCAASNKLYG RTWYDFNESDYWGQGTQVTVSS | 506 |
| PSMA.308 | AC3710 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCAASNKWYG RTWYDFNESDYWGQGTQVTVSS | 507 |
| PSMA.309 | AC3711 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCAASNKWYG RTWYDFNESDYWGQGTQVTVSS | 508 |

TABLE 6f-continued

Anti-PSMA VHH Sequences

| Antibody Name | AC Number | VHH Sequence | SEQ ID NO: |
|---|---|---|---|
| PSMA.310 | AC3712 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYYCGGSNKLYG RTWYDFNESDYWGQGTQVTVSS | 509 |
| PSMA.312 | AC3714 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYYCGASNKLYG RTWYDFNESDYWGQGTQVTVSS | 511 |
| PSMA.314 | AC3716 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYYCAASNKDYG RTWYDFNESDYWGQGTQVTVSS | 513 |
| PSMA.315 | AC3717 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYYCAASNKEYG RTWYDFNESDYWGQGTQVTVSS | 514 |
| PSMA.316 | AC3718 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYYCAASNKGYG RTWYDFNESDYWGQGTQVTVSS | 515 |
| PSMA.331 | AC3733 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCGASNKLYG RTWYDFNESDYWGQGTQVTVSS | 530 |
| PSMA.332 | AC3734 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCAGSNKLYG RTWYDFNESDYWGQGTQVTVSS | 531 |
| PSMA.334 | AC3736 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCAASNKDYG RTWYDFNESDYWGQGTQVTVSS | 533 |
| PSMA.335 | AC3737 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCAASNKEYG RTWYDFNESDYWGQGTQVTVSS | 534 |
| PSMA.336 | AC3738 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCAASNKGYG RTWYDFNESDYWGQGTQVTVSS | 535 |
| PSMA.344 | AC3746 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYFCGGSNKLYG RTWYDFNESDYWGQGTQVTVSS | 543 |
| PSMA.345 | AC3747 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCGGSNKLYG RTWYDFNESDYWGQGTQVTVSS | 544 |
| PSMA.347 | AC3749 | QVQLVESGGGVVQPGRSLRLSCAASG RTFGIYVWGWFRQAPGKEREFVGAMS | 546 |

TABLE 6f-continued

Anti-PSMA VHH Sequences

| Antibody Name | AC Number | VHH Sequence | SEQ ID NO: |
|---|---|---|---|
| | | WSGSNRKVSDSVKGRFTISRDNSKNT LYLQMNSLRAEDTAVYYCGASNKLYG RTWYDFNESDYWGQGTQVTVSS | |
| PSMA.348 | AC3750 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCAASNKRYG RTWYDFNESDYWGQGTQVTVSS | 547 |
| PSMA.349 | AC3751 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCAASNKDYG RTWYDFNESDYWGQGTQVTVSS | 548 |
| PSMA.350 | AC3752 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCAASNKEYG RTWYDFNESDYWGQGTQVTVSS | 549 |
| PSMA.351 | AC3753 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYYCAASNKGYG RTWYDFNESDYWGQGTQVTVSS | 550 |
| PSMA.353 | AC3755 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCGASNKLYG RTWYDFNESDYWGQGTQVTVSS | 552 |
| PSMA.354 | AC3756 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCAASNKRYG RTWYDFNESDYWGQGTQVTVSS | 553 |
| PSMA.355 | AC3757 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCAASNKDYG RTWYDFNESDYWGQGTQVTVSS | 554 |
| PSMA.356 | AC3758 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCAASNKEYG RTWYDFNESDYWGQGTQVTVSS | 555 |
| PSMA.357 | AC3759 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCAASNKGYG RTWYDFNESDYWGQGTQVTVSS | 556 |
| PSMA.358 | AC3760 | QVQLVESGGGVVQPGRSLRLSCAASG RTFGIYVWGWFRQAPGKEREFVGAMS WSGSNRKVSDSVKGRFTISRDNSKNT LYLQMNSLRAEDTAVYFCGGSNKLYG RTWYDFNESDYWGQGTQVTVSS | 557 |

In some embodiments, the disclosure provides an antd-PSMA antibody VHH region comprising the following CDRs: a VHH region CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003); a VHH region CDR2 with an amino acid sequence that that has at least 85%, 90%, 91%, 92%, 93%, 94%, 95%, 96%, 97%, 98%, or 99% identity, or 100% identity, to AMSWSGSNRKVSDSVKG (SEQ ID NO:9004); and a VHH region CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005).

In some embodiments, the antd-PSMA antibody VHH region comprises the following framework regions (FRs): a VHH region FR1 with an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS (SEQ ID NO:9011); a VHH region FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012); a VHH region FR3 with an amino acid sequence that has at least 85%, 90%, 91%, 92%, 93%, 94%, 95%, 96%, 97%, 98%, or 99% identity, or 100% identity, to RFTISRDNSKNTLYLQMNSLRAEDTAVYYC (SEQ ID NO:9013); and a VHH region FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

In some embodiments, the disclosure provides an anti-PSMA antibody VHH region comprising the sequence QVQLVESGGGVVQPGRSLRLSCAAS-GRTFGIYVWGWFRQAPGKEREFVGAMSWSGSNRKV SDSVKGRFTISRDNSKNTLYLQMNSLRAEDTAVYY-CAASNKEYGRTWYDFNESDYWGQGTQ VTVSS (SEQ ID NO: 549), or the CDRs thereof.

Though in some embodiments the binding domain with binding affinity for PSMA is a VHH domain, it is contemplated that in other embodiments a binding domain is used that comprises VL and VH regions from or derived from a monoclonal antibody to PSMA. Exemplary, non-limiting examples of VL and VH sequences are presented in Table 6g. In some embodiments, the present disclosure provides a paTCE composition comprising a first portion binding domain with binding affinity to the tumor-specific marker PSMA comprising anti-PSMA VH and VL sequences set forth in Table 6g. In some embodiments, the present disclosure provides a paTCE composition comprising a first portion binding domain with binding affinity to PSMA tumor-specific marker comprising the CDR-L1 region, the CDR-L2 region, the CDR-L3 region, the CDR-H1 region, the CDR-H2 region, and the CDR-H3 region, wherein each is derived from the respective VL and VH sequences set forth in Table 6g. In some embodiments, the binding has a $K_D$ value of about $10^{-10}$ to $10^{-7}$ M, as determined in an in vitro binding assay. It is specifically contemplated that the paTCE composition can comprise any one of the binding domains disclosed herein or sequence variants thereof so long as the variants exhibit binding specificity for the described antigen.

TABLE 6g

Anti-PSMA VH and VL Sequences

| Target | VH Sequence | SEQ ID NO: | VL Sequence | SEQ ID NO: |
|---|---|---|---|---|
| PSMA | QVQLVESGGGLVKPGES LRLSCAASGFTFSDYYM YWVRQAPGKGLEWVAII SDGGYYTYYSDIIKGRF TISRDNAKNSLYLQMNS | 560 | DIQMTQSPSSLSASVGDRV TITCKASQNVDTNVAWYQQ KPGQAPKSLIYSASYRYSD VPSRFSGSASGTDFTLTIS SVQSEDFATYYCQQYDSYP | 561 |

TABLE 6g-continued

Anti-PSMA VH and VL Sequences

| Target | VH Sequence | SEQ ID NO: | VL Sequence | SEQ ID NO: |
|---|---|---|---|---|
| | LKAEDTAVYYCARGFPL LRHGAMDYWGQGTLVTVSS | | YTFGGGTKLEIK | |
| PSMA | QVQLVESGGGLVKPGES LRLSCAASGFTFSDYYM YWVRQAPGKCLEWVAII SDGGYYTYYSDIIKGRF TISRDNAKNSLYLQMNS LKAEDTAVYYCARGFPL LRHGAMDYWGQGTLVTVSS | 562 | DIQMTQSPSSLSASVGDRV TITCKASQNVDTNVAWYQQ KPGQAPKSLIYSASYVYWD VPSRFSGSASGTDFTLTIS SVQSEDFATYYCQQYDQQL ITFGCGTKLEIK | 563 |

In some embodiments, an anti-PSMA antibody domain comprises a VH region comprising the sequence QVQLVESGGGLVKPGESLRLSCAASGFTFSDYY-MYWVRQAPGKGLEWVAIISDGGYYTYYSDI IKGRFTISRDNAKNSLYLQMNSLKAEDTAVYY-CARGFPLLRHGAMDYWGQGTLVTVSS (SEQ ID NO: 560), or the CDRs thereof, and a VL region comprising the sequence DIQMTQSPSSLSASVGDRVTITCK-ASQNVDTN-VAWYQQKPGQAPKSLIYSASYRYSDVPSRFS GSASGTDFTLTISSVQSEDFATYYCQQYDSYPY-TFGGGTKLEIK (SEQ ID NO: 561), or the CDRs thereof. In some embodiments, an anti-PSMA antibody domain comprises the following sequence:

(SEQ ID NO: 564)
QVQLVESGGGLVKPGESLRLSCAASGFTFSDYYMYWVRQAPGKGLEWVAI

ISDGGYYTYYSDIIKGRFTISRDNAKNSLYLQMNSLKAEDTAVYYCARGF

PLLRHGAMDYWGQGTLVTVSSGGGGSGGGGSGGGGSDIQMTQSPSSLSAS

VGDRVTITCKASQNVDTNVAWYQQKPGQAPKSLIYSASYRYSDVPSRFSG

SASGTDFTLTISSVQSEDFATYYCQQYDSYPYTFGGGTKLEIK.

In some embodiments, an anti-PSMA antibody domain comprises a VH region comprising the sequence QVQLVESGGGLVKPGESLRLSCAASGFTFSDYY-MYWVRQAPGKCLEWVAIISDGGYYTYYSDI IKGRFTISRDNAKNSLYLQMNSLKAEDTAVYY-CARGFPLLRHGAMDYWGQGTLVTVSS (SEQ ID NO: 562), or the CDRs thereof, and a VL region comprising the sequence DIQMTQSPSSLSASVGDRVTITCK-ASQNVDTN-VAWYQQKPGQAPKSLIYSASYVYWDVPSRFS GSASGTDFTLTISSVQSEDFA-TYYCQQYDQQLITFGCGTKLEIK (SEQ ID NO: 563), or the CDRs thereof. In some embodiments, an anti-PSMA antibody domain comprises the following sequence:

(SEQ ID NO: 565)
QVQLVESGGGLVKPGESLRLSCAASGFTFSDYYMYWVRQAPGKCLEWVAI

ISDGGYYTYYSDIIKGRFTISRDNAKNSLYLQMNSLKAEDTAVYYCARGF

PLLRHGAMDYWGQGTLVTVSSGGGGSGGGGSGGGGSDIQMTQSPSSLSAS

VGDRVTITCKASQNVDTNVAWYQQKPGQAPKSLIYSASYVYWDVPSRFSG

SASGTDFTLTISSVQSEDFATYYCQQYDQQLITFGCGTKLEIK.

Linkers and Spacers Between Antibody Regions in Bispecific Antibodies

In some embodiments of the polypeptides of this disclosure, a pair of the light chain variable region (VL) and the heavy chain variable region (VH) of an antigen binding fragment can be linked by a linker, or a long linker (e.g., of hydrophilic amino acids). In some embodiments, a first antigen binding fragment (AF1) (e.g., a VHH domain, such as an anti-PSMA VHH domain) and a second antigen binding fragment (AF2) (e.g., an scFv, such as an anti-CD3 scFv) are linked by a linker, or a long linker (e.g., of hydrophilic amino acids). In some embodiments, a linker linking the light chain variable region (VL) and the heavy chain variable region (VH) of an antigen binding fragment (e.g., a first antigen binding fragment (AF1) and/or a second antigen binding fragment (AF2)), can (each independently) comprise an amino acid sequence having at least 85%, 90%, 91%, 92%, 93%, 94%, 95%, 96%, 97%, 98%, 99% or 100% sequence identity to a sequence set forth in Table A. In some embodiments, a linker linking the light chain variable region (VL) and the heavy chain variable region (VH) of an antigen binding fragment (e.g., a first antigen binding fragment (AF1) and/or a second antigen binding fragment (AF2)), can (each independently) comprise an amino acid sequence identical to a sequence set forth in Table A. In some embodiments of the polypeptides of this disclosure, two antigen binding fragments (e.g., a first and a second antigen binding fragments) can be fused together by a peptide linker, or a short linker. In some embodiments, the peptide linker linking two antigen binding fragments (e.g., a first and a second antigen binding fragments), can comprise an amino acid sequence having at least 85%, 90%, 91%, 92%, 93%, 94%, 95%, 96%, 97%, 98%, 99% or 100% sequence identity to a sequence set forth in Table B. In some embodiments, the peptide linker linking two antigen binding fragments (e.g., a first and a second antigen binding fragments), can comprise an amino acid sequence identical to a sequence set forth in Table B. In some cases, the first antigen binding fragment is a single-chain variable fragment (scFv). In some cases, the second antigen binding fragment is a single-chain variable fragment (scFv). The two single-chain variable fragments of the first and second antigen binding fragments can be linked together by the peptide linker. In some embodiments of the polypeptides of this disclosure, the linker used to link the VHH of the first antigen binding fragment (e.g., an anti-PSMA VHH) and the linker used to link the VL and VH of the second antigen binding fragment (e.g., an anti-CD3 scFv) can be GGGGSGGGS (SEQ ID NO: 125) of Table A. In other embodiments, the linker used to link the VL and VH of an antigen binding fragment (e.g., an anti-CD3 scFv) can be SESATPESGPGTSPGATPESGPGTSESATP (SEQ ID NO: 81). In some embodiments, the disclosure provides polypeptides comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by a short linker of hydrophilic amino acids identified herein by the sequences set forth in Table B and the second and the third variable domains are fused by a long linker identified in Table A. In some embodiments, the selection of the short linker and long linker is to prevent the incorrect pairing of adjacent variable domains, thereby facilitating the formation of the single chain configuration comprising the VL and VH of the first binding moiety and the second binding moiety.

TABLE A

Intramolecular Long Linkers

| Linker # | Name | SEQ ID | Amino Acid Sequence |
|---|---|---|---|
| L1 | (G4S)3 | 112 | GGGGSGGGGSGGGGS |
| L2 | MT110_18 | 113 | GEGTSTGSGGSGGSGGAD |
| L3 | MT103_18 | 114 | VEGGSGGSGGSGGSGGVD |
| L4 | UCHT1_29 | 115 | RTSGPGDGGKGGPGKGPGGEGTKGTGPGG |
| L5 | Y30 | 116 | GSGEGSEGEGGGEGSEGEGSGEGGEGEGSG |
| L6 | Y32 | 117 | TGSGEGSEGEGGGEGSEGEGSGEGGEGEGSGT |
| L7 | G1_30_3 | 118 | GATPPETGAETESPGETTGGSAESEPPGEG |
| L8 | G9_30_1 | 119 | GSAAPTAGTTPSASPAPPTGGSSAAGSPST |
| L9 | Y30_modified | 120 | GEGGESGGSEGEGSGEGEGGSGGEGESEGG |
| L10 | G1_30_1 | 121 | STETSPSTPTESPEAGSGSGSPESPSGTEA |
| L11 | G1_30_2 | 122 | PTGTTGEPSGEGSEPEGSAPTSSTSEATPS |
| L12 | G1_30_4 | 123 | SESESEGEAPTGPGASTTPEPSESPTPETS |
| L13 | UCHT1_modified | 124 | PEGGESGEGTGPGTGGEPEGEGGPGGEGGT |

TABLE B

Intermolecular Short Linkers

| Name | Amino Acid Sequence |
|---|---|
| S-1 | GGGGSGGGS (SEQ ID NO: 125) |
| S-2 | SGGGGS (SEQ ID NO: 86) |
| S-3 | GGGGS (SEQ ID NO: 87) |
| S-4 | GGS |
| S-5 | GSP |

Spacers & TCE Release Segments

Included herein are fusion proteins comprising TCE components that either becomes biologically active or have an increase in biological activity upon release from an ELNN by cleavage of an optional cleavage sequence incorporated within optional spacer sequences into the fusion protein, e.g., as described herein.

In some embodiments, the spacer may be provided to enhance expression of the fusion protein from a host cell and/or to decrease steric hindrance such that the TCE component may assume its desired tertiary structure and/or interact appropriately with its target molecule. For spacers and methods of identifying desirable spacers, see, for example, George, et aL. (2003) Protein Engineering 15:871-879, specifically incorporated by reference herein. In some embodiments, the spacer comprises one or more peptide sequences that are between 1 to 50 amino acid residues in length, or about 1 to 25 residues, or about 1 to 10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine (S), threonine (T), glutamate (E) or proline (P). In some embodiments, the spacer can be a polyglycine or polyalanine, or predominately a mixture of combinations of glycine and alanine residues. In some embodiments, the spacer polypeptide exclusive of a cleavage sequence is substantially devoid of secondary structure. In some embodiments, one or both spacer sequences in a paTCE fusion protein composition may each further contain a cleavage sequence, which may be identical or may be different, wherein the cleavage sequence may be acted on by a protease to release the TCE from the fusion protein.

TABLE C

Exemplary Spacers between a Release Segment and a Bispecific Antibody Domain

| Amino Acid Sequence | SEQ ID NO: |
|---|---|
| STEPS | 89 |
| SATPESGPGT | 90 |
| ATSGSETPGT | 91 |
| GTAEAASASG | 92 |
| STEPSEGSAPGTS | 93 |
| SGPGTS | 94 |
| GTSTEPS | 95 |
| GTSESATPES | 96 |
| GTATPESGPG | 97 |

In some embodiments of the polypeptides of this disclosure, a release segment (RS) (e.g., a first release segment (RS1), a second release segment (RS2), etc.) can be fused to a bispecific antibody domain (BsAb) by a spacer. In some embodiments, a spacer can (each independently) comprise at least 4 types of amino acids that are glycine (G), alanine (A), serine (S), threonine (T), glutamate (E) or proline (P). In some embodiments, the peptides of this disclosure can comprise a first release segment fused to the bispecific antibody domain via a first spacer and a second release segment fused to the bispecific antibody domain via a second spacer. In some embodiments, a spacer (e.g., a first spacer, a second spacer, etc.) can (each independently) comprise an amino acid sequence having at least (about) 80%, at least (about) 90%, or 100% sequence identity to a sequence set forth in Table C. In some embodiments, the spacer (e.g., the first spacer, the second spacer, etc.) can (each independently) comprise an amino acid sequence identical to a sequence set forth in Table C.

In some embodiments, the incorporation of the cleavage sequence into a fusion protein is designed to permit release of a TCE that becomes active or more active upon its release from one or more ELNNs. In some embodiments, cleavage sequences are located sufficiently close to the TCE sequences, generally within 18, or within 12, or within 6, or within 2 amino acids of the TCE sequence terminus, such that any remaining residues attached to the TCE after cleavage do not appreciably interfere with the activity (e.g., such as binding to a receptor) of the TCE yet provide sufficient access to the protease to be able to effect cleavage of the cleavage sequence. In some embodiments, the cleavage site is a sequence that can be cleaved by a protease endogenous to the mammalian subject such that a paTCE can be cleaved after administration to a subject. In such cases, the paTCE can serve as a circulating depot for the TCE. Examples of cleavage sites contemplated herein include, but are not limited to, a polypeptide sequence cleavable by a mammalian endogenous protease listed in Table 7.

In some embodiments, a paTCE fusion protein comprises spacer sequences that comprise one or more cleavage sequences configured to release the TCE from the fusion protein when acted on by a protease. In some embodiments, a spacer sequence does not comprise a cleavage sequence. In some embodiments, the one or more cleavage sequences can be a sequence having at least about 80% (e.g., at least about 85%, at least about 90%, at least about 95%, at least about 96%, at least about 97%, at least about 98%, at least about 99%, or 100%) sequence identify to a sequence from Table 8a or b.

In some embodiments, the disclosure provides TCE release segment polypeptides (or release segments (RSs)) that are substrates for one or more mammalian proteases associated with or produced by disease tissues or cells found in proximity to disease tissues. Such proteases can include, but not be limited to, the classes of proteases such as metalloproteinases, cysteine proteases, aspartate proteases, and serine proteases, including, but not limited to, the proteases of Table 7. The RSs are useful for, amongst other things, incorporation into the subject recombinant polypeptides, conferring an inactive format that can be activated by the cleavage of the RSs by mammalian proteases. As described herein, the RSs are incorporated into the subject recombinant polypeptide compositions, linking the incorporated binding moieties to the ELNN (exemplary configurations of which are described herein) such that upon cleavage of the RSs by action of the one or more proteases for which the RSs are substrates, the binding moieties and ELNN are released from the composition and the binding moieties, no longer shielded by the ELNN, regain their full potential to bind their ligands.

TABLE 7

Proteases of Target Tissues

| Class of Proteases | Protease |
|---|---|
| Metalloproteinases | Meprin |
| | Neprilysin (CD10) |
| | PSMA |
| | BMP-1 |
| | A disintegrin and metalloproteinases (ADAMs) |
| | ADAM8 |
| | ADAM9 |
| | ADAM10 |
| | ADAM12 |
| | ADAM15 |
| | ADAM17 (TACE) |
| | ADAM19 |
| | ADAM28 (MDC-L) |
| | ADAM with thrombospondin motifs (ADAMTS) |
| | ADAMTS1 |
| | ADAMTS4 |
| | ADAMTS5 |
| | Matrix Metalloproteinases (MMPs) |
| | MMP-1 (Collagenase 1) |
| | MMP-2 (Gelatinase A) |
| | MMP-3 (m1) |
| | MMP-7 (Matrilysin 1) |
| | MMP-8 (Collagenase 2) |
| | MMP-9 (Gelatinase B) |
| | MMP-10 (Stromelysin 2) |
| | MMP-11(Stromelysin 3) |
| | MMP-12 (Macrophage elastase) |
| | MMP-13 (Collagenase 3) |
| | MMP-14 (MT1-MMP) |
| | MMP-15 (MT2-MMP) |
| | MMP-19 |
| | MMP-23 (CA-MMP) |
| | MMP-24 (MT5-MMP) |
| | MMP-26 (Matrilysin 2) |
| | MMP-27 (CMMP) |
| Cysteine Proteases | Legumain |
| | Cysteine cathepsins |
| | Cathepsin B |
| | Cathepsin C |
| | Cathepsin K |
| | Cathepsin L |
| | Cathepsin S |
| | Cathepsin X |
| Aspartate Proteases | Cathepsin D |
| | Cathepsin E |
| | Secretase |
| Serine Proteases | Urokinase (uPA) |
| | Tissue-type plasminogen activator (tPA) |
| | Plasmin |
| | Thrombin |
| | Prostate-specific antigen (PSA, KLK3) |
| | Human neutrophil elastase (HNE) |
| | Elastase |
| | Tryptase |
| | Type II transmembrane serine proteases (TTSPs) |
| | DESC1 |
| | Hepsin (HPN) |
| | Matriptase |
| | Matriptase-2 |
| | TMPRSS2 |
| | TMPRSS3 |
| | TMPRSS4 (CAP2) |
| | Fibroblast Activation Protein (FAP) |
| | kallikrein-related peptidase (KLK family) |
| | KLK4 |
| | KLK5 |
| | KLK6 |
| | KLK7 |
| | KLK8 |
| | KLK10 |
| | KLK11 |
| | KLK13 |
| | KLK14 |

In some embodiments, the disclosure provides activatable recombinant polypeptides comprising a first release segment (RS1) sequence having at least 88%, or at least 94%, or 100% sequence identity, when optimally aligned, to a sequence identified in Table 8a, wherein the RS1 is a substrate for one or more mammalian proteases. In some embodiments, the RS is further engineered to remove a legumain cleavage site. In some embodiments, the disclosure provides activatable recombinant polypeptides comprising a RS1 and a second release segment (RS2) sequence, each having at least 88%, or at least 94%, or 100% sequence identity, when optimally aligned, to a sequence identified herein by the sequences set forth in Table 8a, wherein the RS1 and the RS2 each are a substrate for one or more mammalian proteases. In some embodiments, the RS1 and RS2 each do not serve as substrates for legumain.

In some embodiments, disclosure provides activatable recombinant polypeptides comprising a first RS (RS1) sequence having at least 90%, at least 93%, at least 97%, or 100% identity, when optimally aligned, to a sequence identified in Table 8b, wherein the RS1 is a substrate for one or more mammalian proteases. In some embodiments, the disclosure provides activatable recombinant polypeptides comprising a RS1 and a second release segment (RS2) sequence, each having at least 88%, or at least 94%, or 100% sequence identity, when optimally aligned, to a sequence identified herein by the sequences set forth in Table 8b, wherein the RS1 and the RS2 are each a substrate for one or more mammalian proteases (e.g., at one, two, or three cleavage sites within each release segment sequence). In some embodiments of activatable recombinant polypeptides comprising RS1 and RS2, the two release segments can be identical. In some embodiments of activatable recombinant polypeptides comprising RS1 and RS2, the two release segments can be different.

The present disclosure contemplates release segments that are substrates for one, two or three different classes of proteases that are metalloproteinases, cysteine proteases, aspartate proteases, or serine proteases, including the proteases of Table 7. In some embodiments, a paTCE comprises RSs (e.g., RS1 and RS2) that serve as substrates for one or more proteases found in close association with or are co-localized with tumors or cancer cells, and upon cleavage of the RSs, the binding moieties that are otherwise shielded by ELNNs of the paTCE (and thus have a lower binding affinity for their respective ligands) are released from the ELNNs and regain their full potential to bind target and effector cell ligands. In some embodiments, a paTCE comprises RSs (e.g., RS1 and RS2), that each comprise an amino acid sequence that is a substrate for one or more cellular proteases located within a targeted cell, including but not limited to a protease of Table 7. In some embodiments, RSs are substrates for two or three classes of proteases that cleave different portions of each RS. In some embodiments, each RS that is a substrate for two, three, or more classes of proteases has two, three, or more distinct cleavage sites, but cleavage by a single protease nevertheless results in the release of the binding moieties from an ELNN.

In some embodiments, an RS of the disclosure for incorporation into a fusion protein (such as a paTCE) is a substrate for one or more proteases including but not limited to meprin, neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, MMP-1 (collagenase 1), matrix metalloproteinase-1 (MMP-1), matrix metalloproteinase-2 (MMP-2, gelatinase A), matrix metalloproteinase-3 (MMP-3, stromelysin 1), matrix metalloproteinase-7 (MMP-7, Matrilysin 1), matrix metalloproteinase-8 (MMP-8, collagenase 2), matrix metalloproteinase-9 (MMP-9, gelatinase B), matrix metalloproteinase-10 (MMP-10, stromelysin 2), matrix metalloproteinase-11 (MMP-11, stromelysin 3), matrix metalloproteinase-12 (MMP-12, macrophage elastase), matrix metalloproteinase-13 (MMP-13, collagenase 3), matrix metalloproteinase-14 (MMP-14, MT1-MMP), matrix metalloproteinase-15 (MMP-15, MT2-MMP), matrix metalloproteinase-19 (MMP-19), matrix metalloproteinase-23 (MMP-23, CA-MMP), matrix metalloproteinase-24 (MMP-24, MT5-MMP), matrix metalloproteinase-26 (MMP-26, matrilysin 2), matrix metalloproteinase-27 (MMP-27, CMMP), legumain, cathepsin B, cathepsin C, cathepsin K, cathepsin L, cathepsin S, cathepsin X, cathepsin D, cathepsin E, secretase, urokinase (uPA), tissue-type plasminogen activator (tPA), plasmin, thrombin, prostate-specific antigen (PSA, KLK3), human neutrophil elastase (HNE), elastase, tryptase, Type II transmembrane serine proteases (TTSPs), DESC1, hepsin (HPN), matriptase, matriptase-2, TMPRSS2, TMPRSS3, TMPRSS4 (CAP2), fibroblast activation protein (FAP), kallikrein-related peptidase (KLK family), KLK4, KLK5, KLK6, KLK7, KLK8, KLK10, KLK11, KLK13, and KLK14. In some embodiments, the RS is a substrate for ADAM17. In some embodiments, the RS is a substrate for BMP-1. In some embodiments, the RS is a substrate for cathepsin. In some embodiments, the RS is a substrate for HtrA1. In some embodiments, the RS is a substrate for legumain. In some embodiments, the RS is a substrate for MMP-1. In some embodiments, the RS is a substrate for MMP-2. In some embodiments, the RS is a substrate for MMP-7. In some embodiments, the RS is a substrate for MMP-9. In some embodiments, the RS is a substrate for MMP-11. In some embodiments, the RS is a substrate for MMP-14. In some embodiments, the RS is a substrate for uPA. In some embodiments, the RS is a substrate for matriptase. In some embodiments, the RS is a substrate for MT-SP1. In some embodiments, the RS is a substrate for neutrophil elastase. In some embodiments, the RS is a substrate for thrombin. In some embodiments RS is a substrate for TMPRSS3. In some embodiments, the RS is a substrate for TMPRSS4. In some embodiments, the RS of the subject recombinant polypeptide compositions is a substrate for at least two proteases including but not limited to legumain, MMP-1, MMP-2, MMP-7, MMP-9, MMP-11, MMP-14, uPA, and matriptase. In some embodiments, the RS of the subject recombinant polypeptide compositions is a substrate for legumain, MMP-1, MMP-2, MMP-7, MMP-9, MMP-11, MMP-14, uPA, and matriptase. In specific embodiments, the RS of the subject recombinant polypeptide compositions is not a substrate for legumain. In some embodiments, the RS of the subject recombinant polypeptide compositions is a substrate for uPA, matriptase (also known as MT-SP1 and ST14), MMP2, MMP7, MMP9, and MMP14. In some embodiments, the RS of the subject recombinant polypeptide compositions is substrate for uPA, matriptase, MMP2, MMP7, MMP9, and MMP14 but not legumain.

TABLE 8a

TCE Release Segment Sequences.

| Name | Amino Acid Sequence | SEQ ID NO |
|---|---|---|
| RSR-1517 | EAGRSANHEPLGLVAT | 7001 |
| BSRS-A1-1 | ASGRSTNAGPSGLAGP | 7002 |
| BSRS-A2-1 | ASGRSTNAGPQGLAGQ | 7003 |
| BSRS-A3-1 | ASGRSTNAGPPGLTGP | 7004 |
| VP-1 | ASSRGTNAGPAGLTGP | 7005 |
| RSR-1752 | ASSRTTNTGPSTLTGP | 7006 |
| RSR-1512 | AAGRSDNGTPLELVAP | 7007 |
| RSR-1517 | EAGRSANHEPLGLVAT | 7008 |
| VP-2 | ASGRGTNAGPAGLTGP | 7009 |

TABLE 8a-continued

TCE Release Segment Sequences.

| Name | Amino Acid Sequence | SEQ ID NO |
|---|---|---|
| RSR-1018 | LFGRNDNHEPLELGGG | 7010 |
| RSR-1053 | TAGRSDNLEPLGLVFG | 7011 |
| RSR-1059 | LDGRSDNFHPPELVAG | 7012 |
| RSR-1065 | LEGRSDNEEPENLVAG | 7013 |
| RSR-1167 | LKGRSDNNAPLALVAG | 7014 |
| RSR-1201 | VYSRGTNAGPHGLTGR | 7015 |
| RSR-1218 | ANSRGTNKGFAGLIGP | 7016 |
| RSR-1226 | ASSRLTNEAPAGLTIP | 7017 |
| RSR-1254 | DQSRGTNAGPEGLTDP | 7018 |
| RSR-1256 | ESSRGTNIGQGGLTGP | 7019 |
| RSR-1261 | SSSRGTNQDPAGLTIP | 7020 |
| RSR-1293 | ASSRGQNHSPMGLTGP | 7021 |
| RSR-1309 | AYSRGPNAGPAGLEGR | 7022 |
| RSR-1326 | ASERGNNAGPANLTGF | 7023 |
| RSR-1345 | ASHRGTNPKPAILTGP | 7024 |
| RSR-1354 | MSSRRTNANPAQLTGP | 7025 |
| RSR-1426 | GAGRTDNHEPLELGAA | 7026 |
| RSR-1478 | LAGRSENTAPLELTAG | 7027 |
| RSR-1479 | LEGRPDNHEPLALVAS | 7028 |
| RSR-1496 | LSGRSDNEEPLALPAG | 7029 |
| RSR-1508 | EAGRTDNHEPLELSAP | 7030 |
| RSR-1513 | EGGRSDNHGPLELVSG | 7031 |
| RSR-1516 | LSGRSDNEAPLELEAG | 7032 |
| RSR-1524 | LGGRADNHEPPELGAG | 7033 |
| RSR-1622 | PPSRGTNAEPAGLTGE | 7034 |
| RSR-1629 | ASTRGENAGPAGLEAP | 7035 |
| RSR-1664 | ESSRGTNGAPEGLTGP | 7036 |
| RSR-1667 | ASSRATNESPAGLTGE | 7037 |
| RSR-1709 | ASSRGENPPPGGLTGP | 7038 |
| RSR-1712 | AASRGTNTGPAELTGS | 7039 |
| RSR-1727 | AGSRTTNAGPGGLEGP | 7040 |
| RSR-1754 | APSRGENAGPATLTGA | 7041 |
| RSR-1819 | ESGRAANTGPPTLTAP | 7042 |
| RSR-1832 | NPGRAANEGPPGLPGS | 7043 |
| RSR-1855 | ESSRAANLTPPELTGP | 7044 |
| RSR-1911 | ASGRAANETPPGLTGA | 7045 |
| RSR-1929 | NSGRGENLGAPGLTGT | 7046 |
| RSR-1951 | TTGRAANLTPAGLTGP | 7047 |
| RSR-2295 | EAGRSANHTPAGLTGP | 7048 |
| RSR-2298 | ESGRAANTTPAGLTGP | 7049 |
| RSR-2038 | TTGRATEAANLTPAGLTGP | 7050 |
| RSR-2072 | TTGRAEEAANLTPAGLTGP | 7051 |
| RSR-2089 | TTGRAGEAANLTPAGLTGP | 7052 |
| RSR-2302 | TTGRATEAANATPAGLTGP | 7053 |
| RSR-3047 | TTGRAGEAEGATSAGATGP | 7054 |
| RSR-3052 | TTGEAGEAANTSAGATGP | 7055 |
| RSR-3043 | TTGEAGEAAGLTPAGLTGP | 7056 |
| RSR-3041 | TTGAAGEAANATPAGLTGP | 7057 |
| RSR-3044 | TTGRAGEAAGLTPAGLTGP | 7058 |
| RSR-3057 | TTGRAGEAANTSAGATGP | 7059 |
| RSR-3058 | TTGEAGEAAGATSAGATGP | 7060 |
| RSR-2485 | ESGRAANTEPPELGAG | 7061 |
| RSR-2486 | ESGRAANTAPEGLTGP | 7062 |
| RSR-2488 | EPGRAANHEPSGLTEG | 7063 |
| RSR-2599 | ESGRAANHTGAPPGGLTGP | 7064 |
| RSR-2706 | TTGRTGEGANATPGGLTGP | 7065 |
| RSR-2707 | RTGRSGEAANETPEGLEGP | 7066 |
| RSR-2708 | RTGRTGESANETPAGLGGP | 7067 |
| RSR-2709 | STGRTGEPANETPAGLSGP | 7068 |
| RSR-2710 | TTGRAGEPANATPTGLSGP | 7069 |
| RSR-2711 | RTGRPGEGANATPTGLPGP | 7070 |
| RSR-2712 | RTGRGGEAANATPSGLGGP | 7071 |
| RSR-2713 | STGRSGESANATPGGLGGP | 7072 |
| RSR-2714 | RTGRTGEEANATPAGLPGP | 7073 |
| RSR-2715 | ATGRPGEPANTTPEGLEGP | 7074 |
| RSR-2716 | STGRSGEPANATPGGLTGP | 7075 |
| RSR-2717 | PTGRGGEGANTTPTGLPGP | 7076 |
| RSR-2718 | PTGRSGEGANATPSGLTGP | 7077 |
| RSR-2719 | TTGRASEGANSTPAPLTEP | 7078 |
| RSR-2720 | TYGRAAEAANTTPAGLTAP | 7079 |
| RSR-2721 | TTGRATEGANATPAELTEP | 7080 |
| RSR-2722 | TVGRASEEANTTPASLTGP | 7081 |
| RSR-2723 | TTGRAPEAANATPAPLTGP | 7082 |
| RSR-2724 | TWGRATEPANATPAPLTSP | 7083 |
| RSR-2725 | TVGRASESANATPAELTSP | 7084 |
| RSR-2726 | TVGRAPEGANSTPAGLTGP | 7085 |

TABLE 8a-continued

TCE Release Segment Sequences.

| Name | Amino Acid Sequence | SEQ ID NO |
|---|---|---|
| RSR-2727 | TWGRATEAPNLEPATLTTP | 7086 |
| RSR-2728 | TTGRATEAPNLTPAPLTEP | 7087 |
| RSR-2729 | TQGRATEAPNLSPAALTSP | 7088 |
| RSR-2730 | TQGRAAEAPNLTPATLTAP | 7089 |
| RSR-2731 | TSGRAPEATNLAPAPLTGP | 7090 |
| RSR-2732 | TQGRAAEAANLTPAGLTEP | 7091 |
| RSR-2733 | TTGRAGSAPNLPPTGLTTP | 7092 |
| RSR-2734 | TTGRAGGAENLPPEGLTAP | 7093 |
| RSR-2735 | TTSRAGTATNLTPEGLTAP | 7094 |
| RSR-2736 | TTGRAGTATNLPPSGLTTP | 7095 |
| RSR-2737 | TTARAGEAENLSPSGLTAP | 7096 |
| RSR-2738 | TTGRAGGAGNLAPGGLTEP | 7097 |
| RSR-2739 | TTGRAGTATNLPPEGLTGP | 7098 |
| RSR-2740 | TTGRAGGAANLAPTGLTEP | 7099 |
| RSR-2741 | TTGRAGTAENLAPSGLTTP | 7100 |
| RSR-2742 | TTGRAGSATNLGPGGLTGP | 7101 |
| RSR-2743 | TTARAGGAENLTPAGLTEP | 7102 |
| RSR-2744 | TTARAGSAENLSPSGLTGP | 7103 |
| RSR-2745 | TTARAGGAGNLAPEGLTTP | 7104 |
| RSR-2746 | TTSRAGAAENLTPTGLTGP | 7105 |
| RSR-2747 | TYGRTTTPGNEPPASLEAE | 7106 |
| RSR-2748 | TYSRGESGPNEPPPGLTGP | 7107 |
| RSR-2749 | AWGRTGASENETPAPLGGE | 7108 |
| RSR-2750 | RWGRAETTPNTPPEGLTETE | 7109 |
| RSR-2751 | ESGRAANHTGAEPPELGAG | 7110 |
| RSR-2754 | TTGRAGEAANLTPAGLTES | 7111 |
| RSR-2755 | TTGRAGEAANLTPAALTES | 7112 |
| RSR-2756 | TTGRAGEAANLTPAPLTES | 7113 |
| RSR-2757 | TTGRAGEAANLTPEPLTES | 7114 |
| RSR-2758 | TTGRAGEAANLTPAGLTGA | 7115 |
| RSR-2759 | TTGRAGEAANLTPEGLTGA | 7116 |
| RSR-2760 | TTGRAGEAANLTPEPLTGA | 7117 |
| RSR-2761 | TTGRAGEAANLTPAGLTEA | 7118 |
| RSR-2762 | TTGRAGEAANLTPEGLTEA | 7119 |
| RSR-2763 | TTGRAGEAANLTPAPLTEA | 7120 |
| RSR-2764 | TTGRAGEAANLTPEPLTEA | 7121 |
| RSR-2765 | TTGRAGEAANLTPEPLTGP | 7122 |
| RSR-2766 | TTGRAGEAANLTPAGLTGG | 7123 |
| RSR-2767 | TTGRAGEAANLTPEGLTGG | 7124 |
| RSR-2768 | TTGRAGEAANLTPEALTGG | 7125 |
| RSR-2769 | TTGRAGEAANLTPEPLTGG | 7126 |
| RSR-2770 | TTGRAGEAANLTPAGLTEG | 7127 |
| RSR-2771 | TTGRAGEAANLTPEGLTEG | 7128 |
| RSR-2772 | TTGRAGEAANLTPAPLTEG | 7129 |
| RSR-2773 | TTGRAGEAANLTPEPLTEG | 7130 |
| RSR-3213 | EAGRSASHTPAGLTGP | 7628 |

TABLE 8b

Release Segment Sequences

| Name | Amino Acid Sequence | SEQ ID NO: | Name | Amino Acid Sequence | SEQ ID NO: |
|---|---|---|---|---|---|
| RSN-0001 | GSAPGSAGGYAELRMGGAIATSGSETPGT | 7131 | RSC-0001 | GTAEAASASGGSAGGYAELRMGGAIPGSP | 7379 |
| RSN-0002 | GSAPGTGGGYAPLRMGGGAATSGSETPGT | 7132 | RSC-0002 | GTAEAASASGGTGGGYAPLRMGGAPGSP | 7380 |
| RSN-0003 | GSAPGAEGGYAALRMGGEIATSGSETPGT | 7133 | RSC-0003 | GTAEAASASGGAEGGYAALRMGGEIPGSP | 7381 |
| RSN-0004 | GSAPGGPGGYALLRMGGPAATSGSETPGT | 7134 | RSC-0004 | GTAEAASASGGGPGGYALLRMGGPAPGSP | 7382 |
| RSN-0005 | GSAPGEAGGYAFLRMGGSIATSGSETPGT | 7135 | RSC-0005 | GTAEAASASGGEAGGYAFLRMGGSIPGSP | 7383 |
| RSN-0006 | GSAPGPGGGYASLRMGGTAATSGSETPGT | 7136 | RSC-0006 | GTAEAASASGGPGGGYASLRMGGTAPGSP | 7384 |
| RSN-0007 | GSAPGSEGGYATLRMGGAIATSGSETPGT | 7137 | RSC-0007 | GTAEAASASGGSEGGYATLRMGGAIPGSP | 7385 |
| RSN-0008 | GSAPGTPGGYANLRMGGGAATSGSETPGT | 7138 | RSC-0008 | GTAEAASASGGTPGGYANLRMGGAPGSP | 7386 |
| RSN-0009 | GSAPGASGGYAHLRMGGEIATSGSETPGT | 7139 | RSC-0009 | GTAEAASASGGASGGYAHLRMGGEIPGSP | 7387 |
| RSN-0010 | GSAPGGTGGYGELRMGGPAATSGSETPGT | 7140 | RSC-0010 | GTAEAASASGGGTGGYGELRMGGPAPGSP | 7388 |
| RSN-0011 | GSAPGEAGGYPELRMGGSIATSGSETPGT | 7141 | RSC-0011 | GTAEAASASGGEAGGYPELRMGGSIPGSP | 7389 |
| RSN-0012 | GSAPGPGGGYVELRMGGTAATSGSETPGT | 7142 | RSC-0012 | GTAEAASASGGPGGGYVELRMGGTAPGSP | 7390 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-0013 | GSAPGSEGGYLELRMGGAIATSGSETPGT | 7143 | RSC-0013 | GTAEAASASGGSEGGYLELRMGGAIPGSP | 7391 |
| RSN-0014 | GSAPGTPGGYSELRMGGGAATSGSETPGT | 7144 | RSC-0014 | GTAEAASASGGTPGGYSELRMGGGAPGSP | 7392 |
| RSN-0015 | GSAPGASGGYTELRMGGEIATSGSETPGT | 7145 | RSC-0015 | GTAEAASASGGASGGYTELRMGGEIPGSP | 7393 |
| RSN-0016 | GSAPGGTGGYQELRMGGPAATSGSETPGT | 7146 | RSC-0016 | GTAEAASASGGGTGGYQELRMGGPAPGSP | 7394 |
| RSN-0017 | GSAPGEAGGYEELRMGGSIATSGSETPGT | 7147 | RSC-0017 | GTAEAASASGGEAGGYEELRMGGSIPGSP | 7395 |
| RSN-0018 | GSAPGPGIGPAELRMGGTAATSGSETPGT | 7148 | RSC-0018 | GTAEAASASGGPGIGPAELRMGGTAPGSP | 7396 |
| RSN-0019 | GSAPGSEIGAAELRMGGAIATSGSETPGT | 7149 | RSC-0019 | GTAEAASASGGSEIGAAELRMGGAIPGSP | 7397 |
| RSN-0020 | GSAPGTPIGSAELRMGGAATSGSETPGT | 7150 | RSC-0020 | GTAEAASASGGTPIGSAELRMGGGAPGSP | 7398 |
| RSN-0021 | GSAPGASIGTAELRMGGEIATSGSETPGT | 7151 | RSC-0021 | GTAEAASASGGASIGTAELRMGGEIPGSP | 7399 |
| RSN-0022 | GSAPGGTIGNAELRMGGPAATSGSETPGT | 7152 | RSC-0022 | GTAEAASASGGGTIGNAELRMGGPAPGSP | 7400 |
| RSN-0023 | GSAPGEAIGQAELRMGGSIATSGSETPGT | 7153 | RSC-0023 | GTAEAASASGGEAIGQAELRMGGSIPGSP | 7401 |
| RSN-0024 | GSAPGPGGPYAELRMGGTAATSGSETPGT | 7154 | RSC-0024 | GTAEAASASGGPGGPYAELRMGGTAPGSP | 7402 |
| RSN-0025 | GSAPGSEGAYAELRMGGAIATSGSETPGT | 7155 | RSC-0025 | GTAEAASASGGSEGAYAELRMGGAIPGSP | 7403 |
| RSN-0026 | GSAPGTPGVYAELRMGGGAATSGSETPGT | 7156 | RSC-0026 | GTAEAASASGGTPGVYAELRMGGGAPGSP | 7404 |
| RSN-0027 | GSAPGASGLYAELRMGGEIATSGSETPGT | 7157 | RSC-0027 | GTAEAASASGGASGLYAELRMGGEIPGSP | 7405 |
| RSN-0028 | GSAPGGTGIYAELRMGGPAATSGSETPGT | 7158 | RSC-0028 | GTAEAASASGGGTGIYAELRMGGPAPGSP | 7406 |
| RSN-0029 | GSAPGEAGFYAELRMGGSIATSGSETPGT | 7159 | RSC-0029 | GTAEAASASGGEAGFYAELRMGGSIPGSP | 7407 |
| RSN-0030 | GSAPGPGGYYAELRMGGTAATSGSETPGT | 7160 | RSC-0030 | GTAEAASASGGPGGYYAELRMGGTAPGSP | 7408 |
| RSN-0031 | GSAPGSEGSYAELRMGGAIATSGSETPGT | 7161 | RSC-0031 | GTAEAASASGGSEGSYAELRMGGAIPGSP | 7409 |
| RSN-0032 | GSAPGTPGNYAELRMGGGAATSGSETPGT | 7162 | RSC-0032 | GTAEAASASGGTPGNYAELRMGGGAPGSP | 7410 |
| RSN-0033 | GSAPGASGEYAELRMGGEIATSGSETPGT | 7163 | RSC-0033 | GTAEAASASGGASGEYAELRMGGEIPGSP | 7411 |
| RSN-0034 | GSAPGGTGHYAELRMGGPAATSGSETPGT | 7164 | RSC-0034 | GTAEAASASGGGTGHYAELRMGGPAPGSP | 7412 |
| RSN-0035 | GSAPGEAGGYAEARMGGSIATSGSETPGT | 7165 | RSC-0035 | GTAEAASASGGEAGGYAEARMGGSIPGSP | 7413 |
| RSN-0036 | GSAPGPGGGYAEVRMGGTAATSGSETPGT | 7166 | RSC-0036 | GTAEAASASGGPGGGYAEVRMGGTAPGSP | 7414 |
| RSN-0037 | GSAPGSEGGYAEIRMGGAIATSGSETPGT | 7167 | RSC-0037 | GTAEAASASGGSEGGYAEIRMGGAIPGSP | 7415 |
| RSN-0038 | GSAPGTPGGYAEFRMGGGAATSGSETPGT | 7168 | RSC-0038 | GTAEAASASGGTPGGYAEFRMGGGAPGSP | 7416 |
| RSN-0039 | GSAPGASGGYAEYRMGGEIATSGSETPGT | 7169 | RSC-0039 | GTAEAASASGGASGGYAEYRMGGEIPGSP | 7417 |
| RSN-0040 | GSAPGGTGGYAESRMGGPAATSGSETPGT | 7170 | RSC-0040 | GTAEAASASGGGTGGYAESRMGGPAPGSP | 7418 |
| RSN-0041 | GSAPGEAGGYAETRMGGSIATSGSETPGT | 7171 | RSC-0041 | GTAEAASASGGEAGGYAETRMGGSIPGSP | 7419 |
| RSN-0042 | GSAPGPGGGYAELAMGGTRATSGSETPGT | 7172 | RSC-0042 | GTAEAASASGGPGGGYAELAMGGTRPGSP | 7420 |
| RSN-0043 | GSAPGSEGGYAELVMGGARATSGSETPGT | 7173 | RSC-0043 | GTAEAASASGGSEGGYAELVMGGARPGSP | 7421 |
| RSN-0044 | GSAPGTPGGYAELLMGGGRATSGSETPGT | 7174 | RSC-0044 | GTAEAASASGGTPGGYAELLMGGGRPGSP | 7422 |
| RSN-0045 | GSAPGASGGYAELIMGGERATSGSETPGT | 7175 | RSC-0045 | GTAEAASASGGASGGYAELIMGGERPGSP | 7423 |
| RSN-0046 | GSAPGGTGGYAELWMGGPRATSGSETPGT | 7176 | RSC-0046 | GTAEAASASGGGTGGYAELWMGGPRPGSP | 7424 |
| RSN-0047 | GSAPGEAGGYAELSMGGSRATSGSETPGT | 7177 | RSC-0047 | GTAEAASASGGEAGGYAELSMGGSRPGSP | 7425 |

TABLE 8b-continued

Release Segment Sequences

| Name | Amino Acid Sequence | SEQ ID NO: | Name | Amino Acid Sequence | SEQ ID NO: | Name | Amino Acid Sequence | SEQ ID NO: | Name | Amino Acid Sequence | SEQ ID NO: |
|---|---|---|---|---|---|---|---|---|---|---|---|
| RSN-0048 | GSAPGPGGGYAELTMGGTRATSGSETPGT | 7178 | RSC-0048 | GTAEAASASGGPGGGYAELTMGGTRPGSP | 7426 | RSN-0066 | GSAPGPGGGYAELRMIGTIATSGSETPGT | 7196 | RSC-0066 | GTAEAASASGGPGGGYAELRMIGTIPGSP | 7444 |
| RSN-0049 | GSAPGSEGGYAELQMGGARATSGSETPGT | 7179 | RSC-0049 | GTAEAASASGGSEGGYAELQMGGARPGSP | 7427 | RSN-0067 | GSAPGSEGGYAELRMYGAIATSGSETPGT | 7197 | RSC-0067 | GTAEAASASGGSEGGYAELRMYGAIPGSP | 7445 |
| RSN-0050 | GSAPGTPGGYAELNMGGGRATSGSETPGT | 7180 | RSC-0050 | GTAEAASASGGTPGGYAELNMGGGRPGSP | 7428 | RSN-0068 | GSAPGTPGGYAELRMSGGAATSGSETPGT | 7198 | RSC-0068 | GTAEAASASGGTPGGYAELRMSGGAPGSP | 7446 |
| RSN-0051 | GSAPGASGGYAELEMGGERATSGSETPGT | 7181 | RSC-0051 | GTAEAASASGGASGGYAELEMGGERPGSP | 7429 | RSN-0069 | GSAPGASGGYAELRMNGEIATSGSETPGT | 7199 | RSC-0069 | GTAEAASASGGASGGYAELRMNGEIPGSP | 7447 |
| RSN-0052 | GSAPGGTGGYAELRPGGPIATSGSETPGT | 7182 | RSC-0052 | GTAEAASASGGGTGGYAELRPGGPIPGSP | 7430 | RSN-0070 | GSAPGGTGGYAELRMQGPAATSGSETPGT | 7200 | RSC-0070 | GTAEAASASGGGTGGYAELRMQGPAPGSP | 7448 |
| RSN-0053 | GSAPGEAGGYAELRAGGSAATSGSETPGT | 7183 | RSC-0053 | GTAEAASASGGEAGGYAELRAGGSAPGSP | 7431 | RSN-0071 | GSAPGANHTPAGLTGPGARATSGSETPGT | 7201 | RSC-0071 | GTAEAASASGGANHTPAGLTGPGARPGSP | 7449 |
| RSN-0054 | GSAPGPGGGYAELRLGGTIATSGSETPGT | 7184 | RSC-0054 | GTAEAASASGGPGGGYAELRLGGTIPGSP | 7432 | RSN-0072 | GSAPGANTAPEGLTGPSTRATSGSETPGT | 7202 | RSC-0072 | GTAEAASASGGANTAPEGLTGPSTRPGSP | 7450 |
| RSN-0055 | GSAPGSEGGYAELRIGGAAATSGSETPGT | 7185 | RSC-0055 | GTAEAASASGGSEGGYAELRIGGAAPGSP | 7433 | RSN-0073 | GSAPGTGAPPGGLTGPGTRATSGSETPGT | 7203 | RSC-0073 | GTAEAASASGGTGAPPGGLTGPGTRPGSP | 7451 |
| RSN-0056 | GSAPGTPGGYAELRSGGGIATSGSETPGT | 7186 | RSC-0056 | GTAEAASASGGTPGGYAELRSGGGIPGSP | 7434 | RSN-0074 | GSAPGANHEPSGLTEGSPRATSGSETPGT | 7204 | RSC-0074 | GTAEAASASGGANHEPSGLTEGSPRPGSP | 7452 |
| RSN-0057 | GSAPGASGGYAELRNGGEAATSGSETPGT | 7187 | RSC-0057 | GTAEAASASGGASGGYAELRNGGEAPGSP | 7435 | RSN-0075 | GSAPGANTEPPELGAGTERATSGSETPGT | 7205 | RSC-0075 | GTAEAASASGGANTEPPELGAGTERPGSP | 7453 |
| RSN-0058 | GSAPGGTGGYAELRQGGPIATSGSETPGT | 7188 | RSC-0058 | GTAEAASASGGGTGGYAELRQGGPIPGSP | 7436 | RSN-0076 | GSAPGASGPPPGLTGPPGRATSGSETPGT | 7206 | RSC-0076 | GTAEAASASGGASGPPPGLTGPPGRPGSP | 7454 |
| RSN-0059 | GSAPGEAGGYAELRDGGSAATSGSETPGT | 7189 | RSC-0059 | GTAEAASASGGEAGGYAELRDGGSAPGSP | 7437 | RSN-0077 | GSAPGASGTPAPLGGEPGRATSGSETPGT | 7207 | RSC-0077 | GTAEAASASGGASGTPAPLGGEPGRPGSP | 7455 |
| RSN-0060 | GSAPGPGGGYAELREGGTIATSGSETPGT | 7190 | RSC-0060 | GTAEAASASGGPGGGYAELREGGTIPGSP | 7438 | RSN-0078 | GSAPGPAGPPEGLETEAGRATSGSETPGT | 7208 | RSC-0078 | GTAEAASASGGPAGPPEGLETEAGRPGSP | 7456 |
| RSN-0061 | GSAPGSEGGYAELRHGGAAATSGSETPGT | 7191 | RSC-0061 | GTAEAASASGGSEGGYAELRHGGAAPGSP | 7439 | RSN-0079 | GSAPGPTSGQGGLTGPESRATSGSETPGT | 7209 | RSC-0079 | GTAEAASASGGPTSGQGGLTGPESRPGSP | 7457 |
| RSN-0062 | GSAPGTPGGYAELRMPGGIATSGSETPGT | 7192 | RSC-0062 | GTAEAASASGGTPGGYAELRMPGGIPGSP | 7440 | RSN-0080 | GSAPGSAGGAANLVRGGAIATSGSETPGT | 7210 | RSC-0080 | GTAEAASASGGSAGGAANLVRGGAIPGSP | 7458 |
| RSN-0063 | GSAPGASGGYAELRMAGEAATSGSETPGT | 7193 | RSC-0063 | GTAEAASASGGASGGYAELRMAGEAPGSP | 7441 | RSN-0081 | GSAPGTGGGAAPLVRGGAATSGSETPGT | 7211 | RSC-0081 | GTAEAASASGGTGGGAAPLVRGGAPGSP | 7459 |
| RSN-0064 | GSAPGGTGGYAELRMVGPIATSGSETPGT | 7194 | RSC-0064 | GTAEAASASGGGTGGYAELRMVGPIPGSP | 7442 | RSN-0082 | GSAPGAEGGAAALVRGGEIATSGSETPGT | 7212 | RSC-0082 | GTAEAASASGGAEGGAAALVRGGEIPGSP | 7460 |
| RSN-0065 | GSAPGEAGGYAELRMLGSAATSGSETPGT | 7195 | RSC-0065 | GTAEAASASGGEAGGYAELRMLGSAPGSP | 7443 | RSN-0083 | GSAPGGPGGAALLVRGGPAATSGSETPGT | 7213 | RSC-0083 | GTAEAASASGGGPGGAALLVRGGPAPGSP | 7461 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-0084 | GSAPGEAGGAAFLVRGGSIATSGSETPGT | 7214 | RSC-0084 | GTAEAASASGGEAGGAAFLVRGGSIPGSP | 7462 |
| RSN-0085 | GSAPGPGGGAASLVRGGTAATSGSETPGT | 7215 | RSC-0085 | GTAEAASASGGPGGGAASLVRGGTAPGSP | 7463 |
| RSN-0086 | GSAPGSEGGAATLVRGGAIATSGSETPGT | 7216 | RSC-0086 | GTAEAASASGGSEGGAATLVRGGAIPGSP | 7464 |
| RSN-0087 | GSAPGTPGGAAGLVRGGGAATSGSETPGT | 7217 | RSC-0087 | GTAEAASASGGTPGGAAGLVRGGGAPGSP | 7465 |
| RSN-0088 | GSAPGASGGAADLVRGGEIATSGSETPGT | 7218 | RSC-0088 | GTAEAASASGGASGGAADLVRGGEIPGSP | 7466 |
| RSN-0089 | GSAPGGTGGAGNLVRGGPAATSGSETPGT | 7219 | RSC-0089 | GTAEAASASGGGTGGAGNLVRGGPAPGSP | 7467 |
| RSN-0090 | GSAPGEAGGAPNLVRGGSIATSGSETPGT | 7220 | RSC-0090 | GTAEAASASGGEAGGAPNLVRGGSIPGSP | 7468 |
| RSN-0091 | GSAPGPGGGAVNLVRGGTAATSGSETPGT | 7221 | RSC-0091 | GTAEAASASGGPGGGAVNLVRGGTAPGSP | 7469 |
| RSN-0092 | GSAPGSEGGALNLVRGGAIATSGSETPGT | 7222 | RSC-0092 | GTAEAASASGGSEGGALNLVRGGAIPGSP | 7470 |
| RSN-0093 | GSAPGTPGGASNLVRGGGAATSGSETPGT | 7223 | RSC-0093 | GTAEAASASGGTPGGASNLVRGGGAPGSP | 7471 |
| RSN-0094 | GSAPGASGGATNLVRGGEIATSGSETPGT | 7224 | RSC-0094 | GTAEAASASGGASGGATNLVRGGEIPGSP | 7472 |
| RSN-0095 | GSAPGGTGGAQNLVRGGPAATSGSETPGT | 7225 | RSC-0095 | GTAEAASASGGGTGGAQNLVRGGPAPGSP | 7473 |
| RSN-0096 | GSAPGEAGGAENLVRGGSIATSGSETPGT | 7226 | RSC-0096 | GTAEAASASGGEAGGAENLVRGGSIPGSP | 7474 |
| RSN-1517 | GSAPEAGRSANHEPLGLVATATSGSETPGT | 7227 | RSC-1517 | GTAEAASASGEAGRSANHEPLGLVATPGSP | 7475 |
| BSRS-A1-2 | GSAPASGRSTNAGPSGLAGPATSGSETPGT | 7228 | BSRS-A1-3 | GTAEAASASGASGRSTNAGPSGLAGPPGSP | 7476 |
| BSRS-A2-2 | GSAPASGRSTNAGPQGLAGQATSGSETPGT | 7229 | BSRS-A2-3 | GTAEAASASGASGRSTNAGPQGLAGQPGSP | 7477 |
| BSRS-A3-2 | GSAPASGRSTNAGPPGLTGPATSGSETPGT | 7230 | BSRS-A3-3 | GTAEAASASGASGRSTNAGPPGLTGPPGSP | 7478 |
| VP-1 | GSAPASSRGTNAGPAGLTGPATSGSETPGT | 7231 | VP-1 | GTAEAASASGASSRGTNAGPAGLTGPPGSP | 7479 |
| RSN-1752 | GSAPASSRTTNTGPSTLTGPATSGSETPGT | 7232 | RSC-1752 | GTAEAASASGASSRTTNTGPSTLTGPPGSP | 7480 |
| RSN-1512 | GSAPAAGRSDNGTPLELVAPATSGSETPGT | 7233 | RSC-1512 | GTAEAASASGAAGRSDNGTPLELVAPPGSP | 7481 |
| RSN-1517 | GSAPEAGRSANHEPLGLVATATSGSETPGT | 7234 | RSC-1517 | GTAEAASASGEAGRSANHEPLGLVATPGSP | 7482 |
| VP-2 | GSAPASRGTNAGPAGLTGPATSGSETPGT | 7235 | VP-2 | GTAEAASASGASGRGTNAGPAGLTGPPGSP | 7483 |
| RSN-1018 | GSAPLFGRNDNHEPLELGGGATSGSETPGT | 7236 | RSC-1018 | GTAEAASASGLFGRNDNHEPLELGGGPGSP | 7484 |
| RSN-1053 | GSAPTAGRSDNLEPLGLVFGATSGSETPGT | 7237 | RSC-1053 | GTAEAASASGTAGRSDNLEPLGLVFGPGSP | 7485 |
| RSN-1059 | GSAPLDGRSDNFHPPELVAGATSGSETPGT | 7238 | RSC-1059 | GTAEAASASGLDGRSDNFHPPELVAGPGSP | 7486 |
| RSN-1065 | GSAPLEGRSDNEEPENLVAGATSGSETPGT | 7239 | RSC-1065 | GTAEAASASGLEGRSDNEEPENLVAGPGSP | 7487 |
| RSN-1167 | GSAPLKGRSDNNAPLALVAGATSGSETPGT | 7240 | RSC-1167 | GTAEAASASGLKGRSDNNAPLALVAGPGSP | 7488 |
| RSN-1201 | GSAPVYSRGTNAGPHGLTGRATSGSETPGT | 7241 | RSC-1201 | GTAEAASASGVYSRGTNAGPHGLTGRPGSP | 7489 |
| RSN-1218 | GSAPANSRGTNKGFAGLIGPATSGSETPGT | 7242 | RSC-1218 | GTAEAASASGANSRGTNKGFAGLIGPPGSP | 7490 |
| RSN-1226 | GSAPASSRLTNEAPAGLTIPATSGSETPGT | 7243 | RSC-1226 | GTAEAASASGASSRLTNEAPAGLTIPPGSP | 7491 |
| RSN-1254 | GSAPDQSRGTNAGPEGLTDPATSGSETPGT | 7244 | RSC-1254 | GTAEAASASGDQSRGTNAGPEGLTDPPGSP | 7492 |
| RSN-1256 | GSAPESSRGTNIGQGGLTGPATSGSETPGT | 7245 | RSC-1256 | GTAEAASASGESSRGTNIGQGGLTGPPGSP | 7493 |
| RSN-1261 | GSAPSSSRGTNQDPAGLTIPATSGSETPGT | 7246 | RSC-1261 | GTAEAASASGSSSRGTNQDPAGLTIPPGSP | 7494 |
| RSN-1293 | GSAPASSRGQNHSPMGLTGPATSGSETPGT | 7247 | RSC-1293 | GTAEAASASGASSRGQNHSPMGLTGPPGSP | 7495 |
| RSN-1309 | GSAPAYSRGPNAGPAGLEGRATSGSETPGT | 7248 | RSC-1309 | GTAEAASASGAYSRGPNAGPAGLEGRPGSP | 7496 |
| RSN-1326 | GSAPASERGNNAGPANLTGFATSGSETPGT | 7249 | RSC-1326 | GTAEAASASGASERGNNAGPANLTGFPGSP | 7497 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-1345 | GSAPASHRGTNPKPAILTGPATSGSETPGT | 7250 | RSC-1345 | GTAEAASASGASHRGTNPKPAILTGPPGSP | 7498 |
| RSN-1354 | GSAPMSSRRTNANPAQLTGPATSGSETPGT | 7251 | RSC-1354 | GTAEAASASGMSSRRTNANPAQLTGPPGSP | 7499 |
| RSN-1426 | GSAPGAGRTDNHEPLELGAAATSGSETPGT | 7252 | RSC-1426 | GTAEAASASGGAGRTDNHEPLELGAAPGSP | 7500 |
| RSN-1478 | GSAPLAGRSENTAPLELTAGATSGSETPGT | 7253 | RSC-1478 | GTAEAASASGLAGRSENTAPLELTAGPGSP | 7501 |
| RSN-1479 | GSAPLEGRPDNHEPLALVASATSGSETPGT | 7254 | RSC-1479 | GTAEAASASGLEGRPDNHEPLALVASPGSP | 7502 |
| RSN-1496 | GSAPLSGRSDNEEPLALPAGATSGSETPGT | 7255 | RSC-1496 | GTAEAASASGLSGRSDNEEPLALPAGPGSP | 7503 |
| RSN-1508 | GSAPEAGRTDNHEPLELSAPATSGSETPGT | 7256 | RSC-1508 | GTAEAASASGEAGRTDNHEPLELSAPPGSP | 7504 |
| RSN-1513 | GSAPEGGRSDNHGPLELVSGATSGSETPGT | 7257 | RSC-1513 | GTAEAASASGEGGRSDNHGPLELVSGPGSP | 7505 |
| RSN-1516 | GSAPLSGRSDNEAPLELEAGATSGSETPGT | 7258 | RSC-1516 | GTAEAASASGLSGRSDNEAPLELEAGPGSP | 7506 |
| RSN-1524 | GSAPLGGRADNHEPPELGAGATSGSETPGT | 7259 | RSC-1524 | GTAEAASASGLGGRADNHEPPELGAGPGSP | 7507 |
| RSN-1622 | GSAPPPSRGTNAEPAGLTGEATSGSETPGT | 7260 | RSC-1622 | GTAEAASASGPPSRGTNAEPAGLTGEPGSP | 7508 |
| RSN-1629 | GSAPASTRGENAGPAGLEAPATSGSETPGT | 7261 | RSC-1629 | GTAEAASASGASTRGENAGPAGLEAPPGSP | 7509 |
| RSN-1664 | GSAPESSRGTNGAPEGLTGPATSGSETPGT | 7262 | RSC-1664 | GTAEAASASGESSRGTNGAPEGLTGPPGSP | 7510 |
| RSN-1667 | GSAPASSRATNESPAGLTGEATSGSETPGT | 7263 | RSC-1667 | GTAEAASASGASSRATNESPAGLTGEPGSP | 7511 |
| RSN-1709 | GSAPASSRGENPPPGGLTGPATSGSETPGT | 7264 | RSC-1709 | GTAEAASASGASSRGENPPPGGLTGPPGSP | 7512 |
| RSN-1712 | GSAPAASRGTNTGPAELTGSATSGSETPGT | 7265 | RSC-1712 | GTAEAASASGAASRGTNTGPAELTGSPGSP | 7513 |
| RSN-1727 | GSAPAGSRTTNAGPGGLEGPATSGSETPGT | 7266 | RSC-1727 | GTAEAASASGAGSRTTNAGPGGLEGPPGSP | 7514 |
| RSN-1754 | GSAPAPSRGENAGPATLTGAATSGSETPGT | 7267 | RSC-1754 | GTAEAASASGAPSRGENAGPATLTGAPGSP | 7515 |
| RSN-1819 | GSAPESGRAANTGPPTLTAPATSGSETPGT | 7268 | RSC-1819 | GTAEAASASGESGRAANTGPPTLTAPPGSP | 7516 |
| RSN-1832 | GSAPNPGRAANEGPPGLPGSATSGSETPGT | 7269 | RSC-1832 | GTAEAASASGNPGRAANEGPPGLPGSPGSP | 7517 |
| RSN-1855 | GSAPESSRAANLTPPELTGPATSGSETPGT | 7270 | RSC-1855 | GTAEAASASGESSRAANLTPPELTGPPGSP | 7518 |
| RSN-1911 | GSAPASGRAANETPPGLTGAATSGSETPGT | 7271 | RSC-1911 | GTAEAASASGASGRAANETPPGLTGAPGSP | 7519 |
| RSN-1929 | GSAPNSGRGENLGAPGLTGTATSGSETPGT | 7272 | RSC-1929 | GTAEAASASGNSGRGENLGAPGLTGTPGSP | 7520 |
| RSN-1951 | GSAPTTGRAANLTPAGLTGPATSGSETPGT | 7273 | RSC-1951 | GTAEAASASGTTGRAANLTPAGLTGPPGSP | 7521 |
| RSN-2295 | GSAPEAGRSANHTPAGLTGRSATSGSETPGT | 7274 | RSC-2295 | GTAEAASASGEAGRSANHTPAGLTGPPGSP | 7522 |
| RSN-2298 | GSAPESGRAANTTPAGLTGPATSGSETPGT | 7275 | RSC-2298 | GTAEAASASGESGRAANTTPAGLTGPPGSP | 7523 |
| RSN-2038 | GSAPTTGRATEAANLTPAGLTGPATSGSETPGT | 7276 | RSC-2038 | GTAEAASASGTTGRATEAANLTPAGLTGPPGSP | 7524 |
| RSN-2072 | GSAPTTGRAEEAANLTPAGLTGPATSGSETPGT | 7277 | RSC-2072 | GTAEAASASGTTGRAEEAANLTPAGLTGPPGSP | 7525 |
| RSN-2089 | GSAPTTGRAGEAANLTPAGLTGPATSGSETPGT | 7278 | RSC-2089 | GTAEAASASGTTGRAGEAANLTPAGLTGPPGSP | 7526 |
| RSN-2302 | GSAPTTGRATEAANATPAGLTGPATSGSETPGT | 7279 | RSC-2302 | GTAEAASASGTTGRATEAANATPAGLTGPPGSP | 7527 |
| RSN-3047 | GSAPTTGRAGEAEGATSAGATGPATSGSETPGT | 7280 | RSC-3047 | GTAEAASASGTTGRAGEAEGATSAGATGPPGSP | 7528 |
| RSN-3052 | GSAPTTGEAGEAANATSAGATGPATSGSETPGT | 7281 | RSC-3052 | GTAEAASASGTTGEAGEAANATSAGATGPPGSP | 7529 |
| RSN-3043 | GSAPTTGEAGEAAGLTPAGLTGPATSGSETPGT | 7282 | RSC-3043 | GTAEAASASGTTGEAGEAAGLTPAGLTGPPGSP | 7530 |
| RSN-3041 | GSAPTTGAAGEAANATPAGLTGPATSGSETPGT | 7283 | RSC-3041 | GTAEAASASGTTGAAGEAANATPAGLTGPPGSP | 7531 |
| RSN-3044 | GSAPTTGRAGEAAGLTPAGLTGPATSGSETPGT | 7284 | RSC-3044 | GTAEAASASGTTGRAGEAAGLTPAGLTGPPGSP | 7532 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-3057 | GSAPTTGRAGEAANATSAGATGPATSGSETPGT | 7285 | RSC-3057 | GTAEAASASGTTGRAGEAANATSAGATGPPGSP | 7533 |
| RSN-3058 | GSAPTTGEAGEAAGATSAGATGPATSGSETPGT | 7286 | RSC-3058 | GTAEAASASGTTGEAGEAAGATSAGATGPPGSP | 7534 |
| RSN-2485 | GSAPESGRAANTEPPELGAGATSGSETPGT | 7287 | RSC-2485 | GTAEAASASGESGRAANTEPPELGAGPGSP | 7535 |
| RSN-2486 | GSAPESGRAANTAPEGLTGPATSGSETPGT | 7288 | RSC-2486 | GTAEAASASGESGRAANTAPEGLTGPPGSP | 7536 |
| RSN-2488 | GSAPEPGRAANHEPSGLTEGATSGSETPGT | 7289 | RSC-2488 | GTAEAASASGEPGRAANHEPSGLTEGPGSP | 7537 |
| RSN-2599 | GSAPESGRAANHTGAPPGGLTGPATSGSETPGT | 7290 | RSC-2599 | GTAEAASASGESGRAANHTGAPPGGLTGPPGSP | 7538 |
| RSN-2706 | GSAPTTGRTGEGANATPGGLTGPATSGSETPGT | 7291 | RSC-2706 | GTAEAASASGTTGRTGEGANATPGGLTGPPGSP | 7539 |
| RSN-2707 | GSAPRTGRSGEAANETPEGLEGPATSGSETPGT | 7292 | RSC-2707 | GTAEAASASGRTGRSGEAANETPEGLEGPPGSP | 7540 |
| RSN-2708 | GSAPRTGRTGESANETPAGLGGPATSGSETPGT | 7293 | RSC-2708 | GTAEAASASGRTGRTGESANETPAGLGGPPGSP | 7541 |
| RSN-2709 | GSAPSTGRTGEPANETPAGLSGPATSGSETPGT | 7294 | RSC-2709 | GTAEAASASGSTGRTGEPANETPAGLSGPPGSP | 7542 |
| RSN-2710 | GSAPTTGRAGEPANATPTGLSGPATSGSETPGT | 7295 | RSC-2710 | GTAEAASASGTTGRAGEPANATPTGLSGPPGSP | 7543 |
| RSN-2711 | GSAPRTGRPGEGANATPTGLPGPATSGSETPGT | 7296 | RSC-2711 | GTAEAASASGRTGRPGEGANATPTGLPGPPGSP | 7544 |
| RSN-2712 | GSAPRTGRGGEAANATPSGLGGPATSGSETPGT | 7297 | RSC-2712 | GTAEAASASGRTGRGGEAANATPSGLGGPPGSP | 7545 |
| RSN-2713 | GSAPSTGRSGESANATPGGLGGPATSGSETPGT | 7298 | RSC-2713 | GTAEAASASGSTGRSGESANATPGGLGGPPGSP | 7546 |
| RSN-2714 | GSAPRTGRTGEEANATPAGLPGPATSGSETPGT | 7299 | RSC-2714 | GTAEAASASGRTGRTGEEANATPAGLPGPPGSP | 7547 |
| RSN-2715 | GSAPATGRPGEPANTTPEGLEGPATSGSETPGT | 7300 | RSC-2715 | GTAEAASASGATGRPGEPANTTPEGLEGPPGSP | 7548 |
| RSN-2716 | GSAPSTGRSGEPANATPGGLTGPATSGSETPGT | 7301 | RSC-2716 | GTAEAASASGSTGRSGEPANATPGGLTGPPGSP | 7549 |
| RSN-2717 | GSAPPTGRGGEGANTTPTGLPGPATSGSETPGT | 7302 | RSC-2717 | GTAEAASASGPTGRGGEGANTTPTGLPGPPGSP | 7550 |
| RSN-2718 | GSAPPTGRSGEGANATPSGLTGPATSGSETPGT | 7303 | RSC-2718 | GTAEAASASGPTGRSGEGANATPSGLTGPPGSP | 7551 |
| RSN-2719 | GSAPTTGRASEGANSTPAPLTEPATSGSETPGT | 7304 | RSC-2719 | GTAEAASASGTTGRASEGANSTPAPLTEPPGSP | 7552 |
| RSN-2720 | GSAPTYGRAAEAANTTPAGLTAPATSGSETPGT | 7305 | RSC-2720 | GTAEAASASGTYGRAAEAANTTPAGLTAPPGSP | 7553 |
| RSN-2721 | GSAPTTGRATEGANATPAELTEPATSGSETPGT | 7306 | RSC-2721 | GTAEAASASGTTGRATEGANATPAELTEPPGSP | 7554 |
| RSN-2722 | GSAPTVGRASEEANTTPASLTGPATSGSETPGT | 7307 | RSC-2722 | GTAEAASASGTVGRASEEANTTPASLTGPPGSP | 7555 |
| RSN-2723 | GSAPTTGRAPEAANATPAPLTGPATSGSETPGT | 7308 | RSC-2723 | GTAEAASASGTTGRAPEAANATPAPLTGPPGSP | 7556 |
| RSN-2724 | GSAPTWGRATEPANATPAPLTSPATSGSETPGT | 7309 | RSC-2724 | GTAEAASASGTWGRATEPANATPAPLTSPPGSP | 7557 |
| RSN-2725 | GSAPTVGRASESANATPAELTSPATSGSETPGT | 7310 | RSC-2725 | GTAEAASASGTVGRASESANATPAELTSPPGSP | 7558 |
| RSN-2726 | GSAPTVGRAPEGANSTPAGLTGPATSGSETPGT | 7311 | RSC-2726 | GTAEAASASGTVGRAPEGANSTPAGLTGPPGSP | 7559 |
| RSN-2727 | GSAPTWGRATEAPNLEPATLTTPATSGSETPGT | 7312 | RSC-2727 | GTAEAASASGTWGRATEAPNLEPATLTTPPGSP | 7560 |
| RSN-2728 | GSAPTTGRATEAPNLTPAPLTEPATSGSETPGT | 7313 | RSC-2728 | GTAEAASASGTTGRATEAPNLTPAPLTEPPGSP | 7561 |
| RSN-2729 | GSAPTQGRATEAPNLSPAALTSPATSGSETPGT | 7314 | RSC-2729 | GTAEAASASGTQGRATEAPNLSPAALTSPPGSP | 7562 |
| RSN-2730 | GSAPTQGRAAEAPNLTPATLTAPATSGSETPGT | 7315 | RSC-2730 | GTAEAASASGTQGRAAEAPNLTPATLTAPPGSP | 7563 |
| RSN-2731 | GSAPTSGRAPEATNLAPAPLTGPATSGSETPGT | 7316 | RSC-2731 | GTAEAASASGTSGRAPEATNLAPAPLTGPPGSP | 7564 |
| RSN-2732 | GSAPTQGRAAEAANLTPAGLTEPATSGSETPGT | 7317 | RSC-2732 | GTAEAASASGTQGRAAEAANLTPAGLTEPPGSP | 7565 |
| RSN-2733 | GSAPTTGRAGSAPNLPPTGLTTPATSGSETPGT | 7318 | RSC-2733 | GTAEAASASGTTGRAGSAPNLPPTGLTTPPGSP | 7566 |
| RSN-2734 | GSAPTTGRAGGAENLPPEGLTAPATSGSETPGT | 7319 | RSC-2734 | GTAEAASASGTTGRAGGAENLPPEGLTAPPGSP | 7567 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-2735 | GSAPTTSRAGTATNLTPEGLTAPATSGSETPGT | 7320 | RSC-2735 | GTAEAASASGTTSRAGTATNLTPEGLTAPPGSP | 7568 |
| RSN-2736 | GSAPTTGRAGTATNLPPSGLTTPATSGSETPGT | 7321 | RSC-2736 | GTAEAASASGTTGRAGTATNLPPSGLTTPPGSP | 7569 |
| RSN-2737 | GSAPTTARAGEAENLSPSGLTAPATSGSETPGT | 7322 | RSC-2737 | GTAEAASASGTTARAGEAENLSPSGLTAPPGSP | 7570 |
| RSN-2738 | GSAPTTGRAGGAGNLAPGGLTEPATSGSETPGT | 7323 | RSC-2738 | GTAEAASASGTTGRAGGAGNLAPGGLTEPPGSP | 7571 |
| RSN-2739 | GSAPTTGRAGTATNLPPEGLTGPATSGSETPGT | 7324 | RSC-2739 | GTAEAASASGTTGRAGTATNLPPEGLTGPPGSP | 7572 |
| RSN-2740 | GSAPTTGRAGGAANLAPTGLTEPATSGSETPGT | 7325 | RSC-2740 | GTAEAASASGTTGRAGGAANLAPTGLTEPPGSP | 7573 |
| RSN-2741 | GSAPTTGRAGTAENLAPSGLTTPATSGSETPGT | 7326 | RSC-2741 | GTAEAASASGTTGRAGTAENLAPSGLTTPPGSP | 7574 |
| RSN-2742 | GSAPTTGRAGSATNLGPGGLTGPATSGSETPGT | 7327 | RSC-2742 | GTAEAASASGTTGRAGSATNLGPGGLTGPPGSP | 7575 |
| RSN-2743 | GSAPTTARAGGAENLTPAGLTEPATSGSETPGT | 7328 | RSC-2743 | GTAEAASASGTTARAGGAENLTPAGLTEPPGSP | 7576 |
| RSN-2744 | GSAPTTARAGSAENLSPSGLTGPATSGSETPGT | 7329 | RSC-2744 | GTAEAASASGTTARAGSAENLSPSGLTGPPGSP | 7577 |
| RSN-2745 | GSAPTTARAGGAGNLAPEGLTTPATSGSETPGT | 7330 | RSC-2745 | GTAEAASASGTTARAGGAGNLAPEGLTTPPGSP | 7578 |
| RSN-2746 | GSAPTTSRAGAAENLTPTGLTGPATSGSETPGT | 7331 | RSC-2746 | GTAEAASASGTTSRAGAAENLTPTGLTGPPGSP | 7579 |
| RSN-2747 | GSAPTYGRTTTPGNEPPASLEAEATSGSETPGT | 7332 | RSC-2747 | GTAEAASASGTYGRTTTPGNEPPASLEAEPGSP | 7580 |
| RSN-2748 | GSAPTYSRGESPNEPPPGLTGPATSGSETPGT | 7333 | RSC-2748 | GTAEAASASGTYSRGESPNEPPPGLTGPPGSP | 7581 |
| RSN-2749 | GSAPAWGRTGASENETPAPLGGEATSGSETPGT | 7334 | RSC-2749 | GTAEAASASGAWGRTGASENETPAPLGGEPGSP | 7582 |
| RSN-2750 | GSAPRWGRAETTPNTPPEGLETEATSGSETPGT | 7335 | RSC-2750 | GTAEAASASGRWGRAETTPNTPPEGLETEPGSP | 7583 |
| RSN-2751 | GSAPESGRAANHTGAEPPELGAGATSGSETPGT | 7336 | RSC-2751 | GTAEAASASGESGRAANHTGAEPPELGAGPGSP | 7584 |
| RSN-2754 | GSAPTTGRAGEAANLTPAGLTESATSGSETPGT | 7337 | RSC-2754 | GTAEAASASGTTGRAGEAANLTPAGLTESPGSP | 7585 |
| RSN-2755 | GSAPTTGRAGEAANLTPAALTESATSGSETPGT | 7338 | RSC-2755 | GTAEAASASGTTGRAGEAANLTPAALTESPGSP | 7586 |
| RSN-2756 | GSAPTTGRAGEAANLTPAPLTESATSGSETPGT | 7339 | RSC-2756 | GTAEAASASGTTGRAGEAANLTPAPLTESPGSP | 7587 |
| RSN-2757 | GSAPTTGRAGEAANLTPEPLTESATSGSETPGT | 7340 | RSC-2757 | GTAEAASASGTTGRAGEAANLTPEPLTESPGSP | 7588 |
| RSN-2758 | GSAPTTGRAGEAANLTPAGLTGAATSGSETPGT | 7341 | RSC-2758 | GTAEAASASGTTGRAGEAANLTPAGLTGAPGSP | 7589 |
| RSN-2759 | GSAPTTGRAGEAANLTPEGLTGAATSGSETPGT | 7342 | RSC-2759 | GTAEAASASGTTGRAGEAANLTPEGLTGAPGSP | 7590 |
| RSN-2760 | GSAPTTGRAGEAANLTPEPLTGAATSGSETPGT | 7343 | RSC-2760 | GTAEAASASGTTGRAGEAANLTPEPLTGAPGSP | 7591 |
| RSN-2761 | GSAPTTGRAGEAANLTPAGLTEAATSGSETPGT | 7344 | RSC-2761 | GTAEAASASGTTGRAGEAANLTPAGLTEAPGSP | 7592 |
| RSN-2762 | GSAPTTGRAGEAANLTPEGLTEAATSGSETPGT | 7345 | RSC-2762 | GTAEAASASGTTGRAGEAANLTPEGLTEAPGSP | 7593 |
| RSN-2763 | GSAPTTGRAGEAANLTPAPLTEAATSGSETPGT | 7346 | RSC-2763 | GTAEAASASGTTGRAGEAANLTPAPLTEAPGSP | 7594 |
| RSN-2764 | GSAPTTGRAGEAANLTPEPLTEAATSGSETPGT | 7347 | RSC-2764 | GTAEAASASGTTGRAGEAANLTPEPLTEAPGSP | 7595 |
| RSN-2765 | GSAPTTGRAGEAANLTPEPLTGPATSGSETPGT | 7348 | RSC-2765 | GTAEAASASGTTGRAGEAANLTPEPLTGPPGSP | 7596 |
| RSN-2766 | GSAPTTGRAGEAANLTPAGLTGGATSGSETPGT | 7349 | RSC-2766 | GTAEAASASGTTGRAGEAANLTPAGLTGGPGSP | 7597 |
| RSN-2767 | GSAPTTGRAGEAANLTPEGLTGGATSGSETPGT | 7350 | RSC-2767 | GTAEAASASGTTGRAGEAANLTPEGLTGGPGSP | 7598 |
| RSN-2768 | GSAPTTGRAGEAANLTPEALTGGATSGSETPGT | 7351 | RSC-2768 | GTAEAASASGTTGRAGEAANLTPEALTGGPGSP | 7599 |
| RSN-2769 | GSAPTTGRAGEAANLTPEPLTGGATSGSETPGT | 7352 | RSC-2769 | GTAEAASASGTTGRAGEAANLTPEPLTGGPGSP | 7600 |
| RSN-2770 | GSAPTTGRAGEAANLTPAGLTEGATSGSETPGT | 7353 | RSC-2770 | GTAEAASASGTTGRAGEAANLTPAGLTEGPGSP | 7601 |
| RSN-2771 | GSAPTTGRAGEAANLTPEGLTEGATSGSETPGT | 7354 | RSC-2771 | GTAEAASASGTTGRAGEAANLTPEGLTEGPGSP | 7602 |

TABLE 8b-continued

Release Segment Sequences

| Name | Amino Acid Sequence | SEQ ID NO: | Name | Amino Acid Sequence | SEQ ID NO: |
|---|---|---|---|---|---|
| RSN-2772 | GSAPTTGRAGEAANLTPAPLTEGATSGSETPGT | 7355 | RSC-2772 | GTAEAASASGTTGRAGEAANLTPAPLTEGPGSP | 7603 |
| RSN-2773 | GSAPTTGRAGEAANLTPEPLTEGATSGSETPGT | 7356 | RSC-2773 | GTAEAASASGTTGRAGEAANLTPEPLTEGPGSP | 7604 |
| RSN-3047 | GSAPTTGRAGEAEGATSAGATGPATSGSETPGT | 7357 | RSC-3047 | GTAEAASASGTTGRAGEAEGATSAGATGPPGSP | 7605 |
| RSN-2783 | GSAPEAGRSAEATSAGATGPATSGSETPGT | 7358 | RSC-2783 | GTAEAASASGEAGRSAEATSAGATGPPGSP | 7606 |
| RSN-3107 | GSAPSASGTYSRGESGPGSPATSGSETPGT | 7359 | RSC-3107 | GTAEAASASGSASGTYSRGESGPGSPPGSP | 7607 |
| RSN-3103 | GSAPSASGEAGRTDTHPGSPATSGSETPGT | 7360 | RSC-3103 | GTAEAASASGSASGEAGRTDTHPGSPPGSP | 7608 |
| RSN-3102 | GSAPSASGEPGRAAEHPGSPATSGSETPGT | 7361 | RSC-3102 | GTAEAASASGSASGEPGRAAEHPGSPPGSP | 7609 |
| RSN-3119 | GSAPSPAGESSRGTTIAGSPATSGSETPGT | 7362 | RSC-3119 | GTAEAASASGSPAGESSRGTTIAGSPPGSP | 7610 |
| RSN-3043 | GSAPTTGEAGEAAGLTPAGLTGPATSGSETPGT | 7363 | RSC-3043 | GTAEAASASGTTGEAGEAAGLTPAGLTGPPGSP | 7611 |
| RSN-2789 | GSAPEAGESAGATPAGLTGPATSGSETPGT | 7364 | RSC-2789 | GTAEAASASGEAGESAGATPAGLTGPPGSP | 7612 |
| RSN-3109 | GSAPSASGAPLELEAGPGSPATSGSETPGT | 7365 | RSC-3109 | GTAEAASASGSASGAPLELEAGPGSPPGSP | 7613 |
| RSN-3110 | GSAPSASGEPPELGAGPGSPATSGSETPGT | 7366 | RSC-3110 | GTAEAASASGSASGEPPELGAGPGSPPGSP | 7614 |
| RSN-3111 | GSAPSASGEPSGLTEGPGSPATSGSETPGT | 7367 | RSC-3111 | GTAEAASASGSASGEPSGLTEGPGSPPGSP | 7615 |
| RSN-3112 | GSAPSASGTPAPLTEPPGSPATSGSETPGT | 7368 | RSC-3112 | GTAEAASASGSASGTPAPLTEPPGSPPGSP | 7616 |
| RSN-3113 | GSAPSASGTPAELTEPPGSPATSGSETPGT | 7369 | RSC-3113 | GTAEAASASGSASGTPAELTEPPGSPPGSP | 7617 |
| RSN-3114 | GSAPSASGPPPGLTGPPGSPATSGSETPGT | 7370 | RSC-3114 | GTAEAASASGSASGPPPGLTGPPGSPPGSP | 7618 |
| RSN-3115 | GSAPSASGTPAPLGGEPGSPATSGSETPGT | 7371 | RSC-3115 | GTAEAASASGSASGTPAPLGGEPGSPPGSP | 7619 |
| RSN-3125 | GSAPSPAGAPEGLTGPAGSPATSGSETPGT | 7372 | RSC-3125 | GTAEAASASGSPAGAPEGLTGPAGSPPGSP | 7620 |
| RSN-3126 | GSAPSPAGPPEGLETEAGSPATSGSETPGT | 7373 | RSC-3126 | GTAEAASASGSPAGPPEGLETEAGSPPGSP | 7621 |
| RSN-3127 | GSAPSPTSGQGGLTGPGSEPATSGSETPGT | 7374 | RSC-3127 | GTAEAASASGSPTSGQGGLTGPGSEPPGSP | 7622 |
| RSN-3131 | GSAPSESAPPEGLETESTEPATSGSETPGT | 7375 | RSC-3131 | GTAEAASASGSESAPPEGLETESTEPPGSP | 7623 |
| RSN-3132 | GSAPSEGSEPLELGAASETPATSGSETPGT | 7376 | RSC-3132 | GTAEAASASGSEGSEPLELGAASETPPGSP | 7624 |
| RSN-3133 | GSAPSEGSGPAGLEAPSETPATSGSETPGT | 7377 | RSC-3133 | GTAEAASASGSEGSGPAGLEAPSETPPGSP | 7625 |
| RSN-3138 | GSAPSEPTPPASLEAEPGSPATSGSETPGT | 7378 | RSC-3138 | GTAEAASASGSEPTPPASLEAEPGSPPGSP | 7626 |

In some embodiments, a paTCE comprises an RS1 and an RS2 that have different rates of cleavage and different cleavage efficiencies to multiple proteases for which they are substrates. As a given protease may be found in different concentrations in a tumor, compared to healthy tissues or in circulation, the disclosure provides RSs that have a higher or lower cleavage efficiency for a given protease in order to ensure that a paTCE is preferentially converted from the inactive form to the active form (i.e., by the separation and release of the binding moieties and ELNNs from the paTCE after cleavage of the RSs) when in proximity to the cancer cell or tissue and its co-localized proteases compared to the rate of cleavage of the RSs in healthy tissue or the circulation such that the released binding moieties of the TCE have a greater ability to bind to ligands in the tumor compared to the inactive form that remains in circulation. By such selective designs, the therapeutic index of the resulting compositions can be improved, resulting in reduced side effects relative to convention therapeutics that do not incorporate such site-specific activation.

In some embodiments, cleavage efficiency is the log 2 value of the ratio of the percentage of the test substrate comprising the RS cleaved to the percentage of the control substrate AC1611 cleaved when each is subjected to the protease enzyme in biochemical assays in which reaction in conducted wherein the initial substrate concentration is 6 µM, the reactions are incubated at 37° C. for 2 hours before being stopped by adding EDTA, with the amount of digestion products and uncleaved substrate analyzed by non-reducing SDS-PAGE to establish the ratio of the percentage cleaved. The cleavage efficiency may be calculated as follows:

$$\text{Log}_2\left(\frac{\% \text{ Cleaved for substrate of interest}}{\% \text{ cleaved for AC1611 in the same experiement}}\right).$$

Thus, a cleavage efficiency of −1 means that the % cleaved for AC1611 in the same experiment amount of test substrate cleaved was 50% compared to that of the control substrate, while a cleavage efficiency of +1 means that the amount of test substrate cleaved was 200% compared to that of the control substrate. A higher rate of cleavage by the test protease relative to the control would result in a higher cleavage efficiency, and a slower rate of cleavage by the test protease relative to the control would result in a lower cleavage efficiency. A control RS sequence AC1611 (RSR-1517), having the amino acid sequence EAGRSANHEPLGLVAT (SEQ ID NO: 7001), was established as having an appropriate baseline cleavage efficiency by the proteases legumain, MMP-2, MMP-7, MMP-9, MMP-14, uPA, and matriptase, when tested in in vitro biochemical assays for rates of cleavage by the individual proteases. By selective substitution of amino acids at individual locations in the RS peptides, libraries of RS were created and evaluated against the panel of the 7 proteases, resulting in profiles that were used to establish guidelines for appropriate amino acid substitutions in order to achieve RS with desired cleavage efficiencies. In some embodiments, in making RSs with desired cleavage efficiencies, substitutions using the hydrophilic amino acids A, E, G, P, S, and T are preferred, however other L-amino acids can be substituted at given positions in order to adjust the cleavage efficiency so long as the RSs retain at least some susceptibility to cleavage by a given protease. Conservative substitutions of amino acids in a peptide to retain or effect activity is well within the knowledge and capabilities of a person within skill in the art. In some embodiments, the disclosure provides an RS in which the RS is cleaved by a protease including but not limited to MMP-2, MMP-7, MMP-9, MMP-14, uPA, or matriptase (also known as MT-SP1) with at least a 0.2 $\log_2$, or 0.4 $\log_2$, or 0.8 $\log_2$, or 1.0 $\log_2$ higher cleavage efficiency in an in vitro biochemical competitive assay compared to the cleavage by the same protease of a control sequence RSR-1517 having the sequence EAGRSANHEPLGLVAT (SEQ ID NO: 7001). In some embodiments, the disclosure provides an RS in which the RS is cleaved by a protease including but not limited to MMP-2, MMP-7, MMP-9, MMP-11, uPA, or matriptase with at least a 0.2 $\log_2$, or 0.4 $\log_2$, or 0.8 $\log_2$, or 1.0 $\log_2$ lower cleavage efficiency in an in vitro biochemical competitive assay compared to the cleavage by the same protease of a control sequence RSR-1517 having the sequence EAGRSANHEPLGLVAT (SEQ ID NO: 7001). In some embodiments, the disclosure provides an RS in which the rate of cleavage of the RS by a protease including but not limited to MMP-2, MMP-7, MMP-9, MMP-14, uPA, or matriptase is at least 2-fold, or at least 4-fold, or at least 8 fold, or at least 16-fold faster compared to the control sequence RSR-1517 having the sequence EAGRSANHEPLGLVAT (SEQ ID NO: 7001). In some embodiments, the disclosure provides an RS in which the rate of cleavage of the RS by a protease including but not limited to MMP-2, MMP-7, MMP-9, MMP-14, uPA, or matriptase is at least 2-fold, or at least 4-fold, or at least 8-fold, or at least 16-fold slower compared to the control sequence RSR-1517 having the sequence EAGRSANHEPLGLVAT (SEQ ID NO: 7001).

In some embodiments, the RS comprises the amino acid sequence EAGRSAXHTPAGLTGP (SEQ ID NO: 7627), wherein X is any amino acid other than N. In some embodiments, X is S. In some embodiments, X is T. In some embodiments, X is Y. In some embodiments, X is Q. In some embodiments, X is G. In some embodiments, X is A. In some embodiments, X is V. In some embodiments, X is C. In some embodiments, X is P. In some embodiments, X is L. In some embodiments, X is I. In some embodiments, X is M. In some embodiments, X is F. In some embodiments, X is K. In some embodiments, X is R. In some embodiments, X is H. In some embodiments, X is D. In some embodiments, X is E. In some embodiments, the RS is not cleaved by legumain. In some embodiments, the RS is not cleavable by legumain in human blood, plasma, or serum.

In some embodiments, the RS is not cleavable upon incubation with about 1 nM or less legumain for about 20 hours. In some embodiments, the RS is cleaved by legumain less quickly or efficiently than RSR-2295 (EAGRSANHTPAGLTGP) (SEQ ID NO:7048) is cleaved by legumain. In some embodiments, the RS is cleaved by legumain at a rate that is less than about 50% of the rate that legumain cleaves RSR-2295 (EAGRSANHTPAGLTGP) (SEQ ID NO:7048). In some embodiments, the RS is cleaved by legumain at a rate that is less than about 25% of the rate that legumain cleaves RSR-2295. In some embodiments, the RS is cleaved by legumain at a rate that is less than about 10% of the rate that legumain cleaves RSR-2295. In some embodiments, the RS is cleaved by legumain at a rate that is less than about 5% of the rate that legumain cleaves RSR-2295. In some embodiments, the RS is cleaved by legumain at a rate that is less than about 2.5% of the rate that legumain cleaves RSR-2295.

In some embodiments, the RS is cleaved by legumain at a rate that is less than about 50% of the rate that legumain cleaves RSR-2295 (EAGRSANHTPAGLTGP) (SEQ ID NO:7048) in human plasma. In some embodiments, the RS is cleaved by legumain at a rate that is less than about 25% of the rate that legumain cleaves RSR-2295 in human plasma. In some embodiments, the RS is cleaved by legumain at a rate that is less than about 10% of the rate that legumain cleaves RSR-2295 in human plasma. In some embodiments, the RS is cleaved by legumain at a rate that is less than about 5% of the rate that legumain cleaves RSR-2295 in human plasma. In some embodiments, the RS is cleaved by legumain at a rate that is less than about 2.5% of the rate that legumain cleaves RSR-2295 in human plasma.

In some embodiments, the disclosure provides paTCEs comprising multiple RSs wherein each RS sequence is identified herein by the group of sequences set forth in Table 8a and the RSs are linked to each other by 1 to 6 amino acids that are glycine, serine, alanine, and threonine. In some embodiments, a paTCE comprises a first RS and a second RS different from the first RS wherein each RS sequence is identified herein by a sequence set forth in Table 8a and the RSs are linked to each other by 1 to 6 amino acids that are glycine, serine, alanine, and threonine. In some embodiments, the paTCE comprises a first RS, a second RS different from the first RS, and a third RS different from the first and the second RS wherein each sequence is identified herein by s sequence set forth in Table 8a and the first and the second and the third RS are linked to each other by 1 to 6 amino acids that are glycine, serine, alanine, and threonine. In some embodiments, multiple RS of the paTCE can be concatenated to form a sequence that can be cleaved by multiple proteases at different rates or efficiency of cleavage. In some embodiments, the disclosure provides a paTCE comprising an RS1 and an RS2, wherein each has a sequence set forth in Table 8a or 8b and ELNNs (e.g., an ELNN1 and ELNN2), such as those described herein, wherein the RS1 is fused between the ELNN1 and the binding moieties and the RS2 is fused between the ELNN2 and the binding moieties. In some embodiments, a paTCE is more readily cleaved in target tissues that express multiple proteases (e.g., tumor tissues), compared with healthy tissues or when in the normal circulation, with the result that the resulting fragments bearing the binding moieties would more readily penetrate the target tissue; e.g., a tumor, and have an enhanced ability to bind and link the cancer cell and the effector cell.

In some embodiments, a paTCE comprises a first release segment (RS1) positioned between a first ELNN a bispecific antibody. In some embodiments, the polypeptide further comprises a second release segment (RS2) positioned between the bispecific antibody and a second ELNN. In some embodiments, RS1 and RS2 are identical in sequence. In some embodiments, RS1 and RS2 are not identical in sequence. In some embodiments, the RS1 comprises an amino acid sequence having at least 85%, 90%, 91%, 92%, 93%, 94%, 95%, 96%, 97%, 98%, 99% or 100% sequence identity to a sequence identified herein in Table 8a or 8b or a subset thereof. In some embodiments, the RS2 comprises an amino acid sequence having at least 85%, 90%, 91%, 92%, 93%, 94%, 95%, 96%, 97%, 98%, 99% or 100% sequence identity to a sequence identified herein in Table 8a or 8b or a subset thereof. In some embodiments, the RS1 and RS2 are each a substrate for cleavage by multiple proteases at one, two, or three cleavage sites within each release segment sequence.

In some embodiments, the paTCE further comprises one or more reference fragments (e.g., barcode fragments) releasable from the paTCE upon digestion by the protease. In some embodiments, the one or more reference fragments is a single reference fragment that differs in sequence and molecular weight from all other peptide fragments that are releasable from the polypeptide upon digestion of the polypeptide by the protease.

Exemplary PaTCEs

In some embodiments, a paTCE comprises an amino acid sequence having at least (about) 80% sequence identity to a sequence set forth in Table D (consisting of SEQ ID NOS: 1000-1009) or a subset thereof. In some embodiments, the paTCE comprises an amino acid sequence having at least (about) 81%, at least (about) 82%, at least (about) 83%, at least (about) 84%, at least (about) 85%, at least (about) 86%, at least (about) 87%, at least (about) 88%, at least (about) 89%, at least (about) 90%, at least (about) 91%, at least (about) 92%, at least (about) 93%, at least (about) 94%, at least (about) 95%, at least (about) 96%, at least (about) 97%, at least (about) 98%, at least (about) 99%, or (about) 100% sequence identity to a sequence set forth in Table D (SEQ ID NOS: 1000-1009) or a subset thereof. In some embodiments, the paTCE comprises an amino acid sequence having at least (about) 90%, at least (about) 91%, at least (about) 92%, at least (about) 93%, at least (about) 94%, at least (about) 95%, at least (about) 96%, at least (about) 97%, at least (about) 98%, at least (about) 99%, or (about) 100% sequence identity to a sequence set forth in Table D (SEQ ID NOS: 1000-1009) or a subset thereof. In some embodiments, the paTCE comprises an amino acid sequence identical to a sequence set forth in Table D (SEQ ID NOS: 1000-1009). It is specifically contemplated that the compositions of this disclosure can comprise sequence variants of the amino acid sequences set forth in Table D, such as with linker sequence(s) substituted or inserted or with purification tag sequence(s) attached thereto, so long as the variants exhibit substantially similar or same bioactivity/bioactivities and/or activation mechanism(s).

TABLE D

Exemplary amino acid sequences of polypeptides

| SEQ ID NO | AMINO ACID SEQUENCE |
|---|---|
| 1000 (AMX-500) | ASSATPESGPGTSTEPSEGSAPGTSESATPESGPGSGPGTSESATPGTSE SATPESGPGSEPATSGSETPGTSESATPESGPGTSTEPSEGSAPGSPAGS PTSTEEGTSESATPESGPGSEPATSGSETPGTSESATPESGPGSPAGSPT STEEGSPAGSPTSTEEGTSTEPSEGSAPGTSESATPESGPGTSESATPES GPGTSESATPESGPGSEPATSGSETPGSEPATSGSETPGSPAGSPTSTEE GTSTEPSEGSAPGTSTEPSEGSAPGSEPATSGSETPGTSESATPEAGRSA SHTPAGLTGPGTSESATPESQVQLVESGGGVVQPGRSLRLSCAASGRTFG IYVWGWFRQAPGKEREFVGAMSWSGSNRKVSDSVKGRFTISRDNSKNTL YLQMNSLRAEDTAVYYCAASNKEYGRTWYDFNESDYWGQGTQVTVSSGG GGSGGGSELVVTQEPSLTVSPGGTVTLTCRSSNGAVTSSNYANWVQQKP GQAPRGLIGGTNKRAPGTPARFSGSLLGGKAALTLSGVQPEDEAVYYCAL WYPNLWVFGGGTKLTVLSESATPESGPGTSPGATPESGPGTSESATPEVQ LVESGGGIVQPGGSLRLSCAASGFTFSTYAMNWVRQAPGKGLEWVGRIRT KRNNYATYYADSVKGRFTISRDDSKNTVYLQMNSLKTEDTAVYYCVRHENF GNSYVSWFAHWGQGTLVTVSSGTATPESGPGEAGRSASHTPAGLTGPAT PESGPGTSESATPESGPGSPAGSPTSTEEGTSESATPESGPGSEPATSGS ETPGTSESATPESGPGTSTEPSEGSAPGTSTEPSEGSAPGTSTEPSEGSA PGTSTEPSEGSAPGTSTEPSEGSAPGTSTEPSEGSAPGSPAGSPTSTEEG TSTEPSEGSAPGTSESATPESGPGSEPATSGSETPGTSESATPESGPGSE PATSGSETPGTSESATPESGPGTSTEPSEGSAPGTSESATPESGPGSPAG SPTSTEEGSPAGSPTSTEEGSPAGSPTSTEEGTSESATPESGPGTSTEPSE GSAPGTSESATPESGPGSEPATSGSETPGTSESATPESGPGSEPATSGSE TPGTSESATPESGPGTSTEPSEGSAPGSPAGSPTSTEEGTSESATPESGP GSEPATSGSETPGTSESATPESGPGSPAGSPTSTEEGSPAGSPTSTEEGT STEPSEGSAPGTSESATPESGPGTSESATPESGPGTSPSATPESGPGSEP ATSGSETPGSEPATSGSETPGSPAGSPTSTEEGTSTEPSEGSAPGTSTEP SEGSAPGSEPATSGSETPGTSESAGEPEA |
| 1001 (AC3092) | ASSPAGSPTSTESGTSESATPESGPGTSTEPSEGSAPGTSESATPESGPG SEPATSGSETPGTSESATPESGPGSTPAESGSETPGTSESATPESGPGTS TEPSEGSAPGSPAGSPTSTEEGTSESATPESGPGSEPATSGSETPGTSES ATPESGPGSPAGSPTSTEEGSPAGSPTSTEEGTSTEPSEGSAPGTSESAT PESGPGTSESATPESGPGTSESATPESGPGSEPATSGSETPGSEPATSGS ETPGSPAGSPTSTEEGTSTEPSEGSAPGTSTEPSEGSAPGGSAPEAGRSA NHTPAGLTGPATSGSETPGTQVQLVESGGGVVQPGRSLRLSCAASGRTFG |

TABLE D-continued

Exemplary amino acid sequences of polypeptides

| SEQ ID NO | AMINO ACID SEQUENCE |
|---|---|
| | IYVMGWVRQAPGKEREFVAAISWSGSNRLVSDSVKGRFTISRDNSKNTLYL QMNSLRAEDTAVYYCAASNRLYGRTWYDFNESDYWGQGTQVTVSSGGG GSGGGGSELVVTQEPSLTVSPGGTVTLTCRSSNGAVTSSNYANWVQQKPG QAPRGLIGGTNKRAPGTPARFSGSLLGGKAALTLSGVQPEDEAVYYCALW YPNLWVFGGGTKLTVLGATPPETGAETESPGETTGGSAESEPPGEGEVQL LESGGGIVQPGGSLKLSCAASGFTFNTYAMNWVRQAPGKGLEWVARIRSK YNNYATYYADSVKDRFTISRDDSKNTVYLQMNNLKTEDTAVYYCVRHENFG NSYVSWFAHWGQGTLVTVSSGTAEAASASGEAGRSANHTPAGLTGPPGS PAGSPTSTEEGTSESATPESGPGSEPATSGSETPGTSESATPESGPGTST EPSEGSAPGTSTEPSEGSAPGTSTEPSEGSAPGTSTEPSEGSAPGTSTEP SEGSAPGTSTEPSEGSAPGSPAGSPTSTEEGTSTEPSEGSAPGTSESATP ESGPGSEPATSGSETPGTSESATPESGPGSEPATSGSETPGTSESATPES GPGTSTEPSEGSAPGTSESATPESGPGSPAGSPTSTEEGSPAGSPTSTEE GSPAGSPTSTEEGTSESATPESGPGTSTEPSEGSAPGTSESATPESGPGS EPATSGSETPGTSESATPESGPGSEPATSGSETPGTSESATPESGPGTST EPSEGSAPGSPAGSPTSTEEGTSESATPESGPGSEPATSGSETPGTSESA TPESGPGSPAGSPTSTEEGSPAGSPTSTEEGTSTEPSEGSAPGTSESATP ESGPGTSESATPESGPGTSESATPESGPGSEPATSGSETPGSEPATSGSE TPGSPAGSPTSTEEGTSTEPSEGSAPGTSESTPSEGSAPGSEPATSGSETP GTSESATPESGPGTSTEPSEGSAPGEPEA |
| 1002 (AC3445)* | ASHHHHHHSATPESGPGTSTEPSEGSAPGTSESATPESGPGSGPGTSESA TPGTSESATPESGPGSEPATSGSETPGTSESATPESGPGTSTEPSEGSAP GSPAGSPTSTEEGTSESATPESGPGSEPATSGSETPGTSESATPESGPGS PAGSPTSTEEGSPAGSPTSTEEGTSTEPSEGSAPGTSESATPESGPGTSE SATPESGPGTSESATPESGPGSEPATSGSETPGSEPATSGSETPGSPAGS PTSTEEGTSTEPSEGSAPGTSTEPSEGSAPGSEPATSGSETPGTSESATPE AGRSANHTPAGLTGPGTSESATPESQVQLVESGGGVVQPGRSLRLSCAAS GRTFGIYVMGWVRQAPGKEREFVAAISWSGSNRKVSDSVKGRFTISRDNS KNTLYLQMNSLRAEDTAVYYCAASNRLYGRTWYDFNESDYWGQGTQVTV SSGGGGSGGGSELVVTQEPSLTVSPGGTVTLTCRSSNGAVTSSNYANWV QQKPGQAPRGLIGGTNKRAPGTPARFSGSLLGGKAALTLSGVQPEDEAVY YCALWYPNLWVFGGGTKLTVLSESATPESGPGTSPGATPESGPGTSESAT PEVQLLESGGGIVQPGGSLKLSCAASGFTFNTYAMNWVRQAPGKGLEWV ARIRSKYNNYATYYADSVKDRFTISRDDSKNTVYLQMNNLKTEDTAVYYCV RHENFGNSYVSWFAHWGQGTLVTVSSGTATPESGPGEAGRSANHTPAGL TGPATPESGPGTSESATPESGPGSPAGSPTSTEEGTSESATPESGPGSEP ATSGSETPGTSESATPESGPGSTEPSEGSAPGTSTEPSEGSAPGTSTEP SEGSAPGTSTEPSEGSAPGTSTEPSEGSAPGSPAGSPT STEEGTSTEPSEGSAPGTSESATPESGPGSEPATSGSETPGTSESATPES GPGSEPATSGSETPGTSESATPESGPGTSTEPSEGSAPGTSESATPESGP GSPAGSPTSTEEGSPAGSPTSTEEGSPAGSPTSTEEGTSESATPESGPGT STEPSEGSAPGTSESATPESGPGSEPATSGSETPGTSESATPESGPGSEP ATSGSETPGTSESATPESGPGTSTEPSEGSAPGSPAGSPTSTEEGTSESA TPESGPGSEPATSGSETPGTSESATPESGPGSPAGSPTSTEEGSPAGSPT STEEGTSTEPSEGSAPGTSESATPESGPGTSESATPESGPGTSPSATPES GPGSEPATSGSETPGSEPATSGSETPGSPAGSPTSTEEGTSTEPSEGSAP GTSTEPSEGSAPGSEPATSGSETPGTSESAGEPEA |
| 1003 (AC3928) | ASSATPESGPGTSTEPSEGSAPGTSESATPESGPGSGPGTSESATPGTSE SATPESGPGSEPATSGSETPGTSESATPESGPGTSTEPSEGSAPGSPAGS PTSTEEGTSESATPESGPGSEPATSGSETPGTSESATPESGPGSPAGSPT STEEGSPAGSPTSTEEGTSTEPSEGSAPGTSESATPESGPGTSESATPES GPGTSESATPESGPGSEPATSGSETPGSEPATSGSETPGSPAGSPTSTEE GTSTEPSEGSAPGTSTEPSEGSAPGSEPATSGSETPGTSESATPEAGRSA SHTPAGLTGPGTSESATPESQVQLVESGGGVVQPGRSLRLSCAASGRTFG IYVWGWFRQAPGKEREFVGAMSWSGSNRKVSDSVKGRFTISRDNSKNTL YLQMNSLRAEDTAVYYCAASNKEYGRTWYDFNESDYWGQGTQVTVSSGG GGSGGGSELVVTQEPSLTVSPGGTVTLTCRSSNGAVTSSNYANWVQQKP GQAPRGLIGGTNKRAPGTPARFSGSLLGGKAALTLSGVQPEDEAVYYCAL WYPNLWVFGGGTKLTVLSESATPESGPGTSPGATPESGPGTSESATPEVQ LLESGGGIVQPGGSLKLSCAASGFTFNTYAMNWVRQAPGKGLEWVARIRS KYNNYATYYADSVKDRFTISRDDSKNTVYLQMNNLKTEDTAVYYCVRHENF GNSYVSWFAHWGQGTLVTVSSGTATPESGPGEAGRSASHTPAGLTGPAT PESGPGTSESATPESGPGSPAGSPTSTEEGTSESATPESGPGSEPATSGS ETPGTSESATPESGPGTSTEPSEGSAPGTSTEPSEGSAPGTSTEPSEGSA PGTSTEPSEGSAPGTSTEPSEGSAPGTSTEPSEGSAPGSPAGSPTSTEEG TSTEPSEGSAPGTSESATPESGPGSEPATSGSETPGTSESATPESGPGSE PATSGSETPGTSESATPESGPGTSTEPSEGSAPGTSESATPESGPGSPAG SPTSTEEGSPAGSPTSTEEGSPAGSPTSTEEGTSESATPESGPGTSTEPSE GSAPGTSESATPESGPGSEPATSGSETPGTSESATPESGPGSEPATSGSE TPGTSESATPESGPGTSTEPSEGSAPGSPAGSPTSTEEGTSESATPESGP |

TABLE D-continued

Exemplary amino acid sequences of polypeptides

| SEQ ID NO | AMINO ACID SEQUENCE |
|---|---|
| | GSEPATSGSETPGTSESATPESGPGSPAGSPTSTEEGSPAGSPTSTEEGT STEPSEGSAPGTSESATPESGPGTSESATPESGPGTSPSATPESGPGSEP ATSGSETPGSEPATSGSETPGSPAGSPTSTEEGTSTEPSEGSAPGTSTEP SEGSAPGSEPATSGSETPGTSESAGEPEA |
| 1004 (AC3934) | ASSATPESGPGTSTEPSEGSAPGTSESATPESGPGSGPGTSESATPGTSE SATPESGPGSEPATSGSETPGTSESATPESGPGTSTEPSEGSAPGSPAGS PTSTEEGTSESATPESGPGSEPATSGSETPGTSESATPESGPGSPAGSPT STEEGSPAGSPTSTEEGTSTEPSEGSAPGTSESATPESGPGTSESATPES GPGTSESATPESGPGSEPATSGSETPGSEPATSGSETPGSPAGSPTSTEE GTSTEPSEGSAPGTSTEPSEGSAPGSEPATSGSETPGTSESATPEAGRSA SHTPAGLTGPGTSESATPESGPGSGPGTSESATPESQVQLVESGGGVVQPGRSLRLSCAASGRTFG IYVWGWVRQAPGKEREFVGAISWSGSNRKVSDSVKGRFTISRDNSKNTLY LQMNSLRAEDTAVYYCAASNKLYGRTWYDFNESDYWGQGTQVTVSSGGG GSGGGSELVVTQEPSLTVSPGGTVTLTCRSSNGAVTSSNYANWVQQKPG QAPRGLIGGTNKRAPGTPARFSGSLLGGKAALTLSGVQPEDEAVYYCALW YPNLWVFGGGTKLTVLSESATPESGPGTSPGATPESGPGTSESATPEVQL VESGGGIVQPGGSLRLSCAASGFTFSTYAMNWVRQAPGKGLEWVGRIRTK RNNYATYYADSVKGRFTISRDDSKNTVYLQMNSLKTEDTAVYYCVRHENF GNSYVSWFAHWGQGTLVTVSSGTATPESGPGEAGRSASHTPAGLTGPAT PESGPGTSESATPESGPGSPAGSPTSTEEGTSESATPESGPGSEPATSGS ETPGTSESATPESGPGSTEPSEGSAPGTSTEPSEGSAPGTSTEPSEGSA PGTSTEPSEGSAPGTSTEPSEGSAPGTSTEPSEGSAPGSPAGSPTSTEEG TSTEPSEGSAPGTSESATPESGPGSEPATSGSETPGTSESATPESGPGSE PATSGSETPGTSESATPESGPGTSTEPSEGSAPGTSESATPESGPGSPAG SPTSTEEGSPAGSPTSTEEGSPAGSPTSTEEGTSESATPESGPGTSTEPSE GSAPGTSESATPESGPGSEPATSGSETPGTSESATPESGPGSEPATSGSE TPGTSESATPESGPGTSTEPSEGSAPGSPAGSPTSTEEGTSESATPESGP GSEPATSGSETPGTSESATPESGPGSPAGSPTSTEEGSPAGSPTSTEEGT STEPSEGSAPGTSESATPESGPGTSESATPESGPGTSPSATPESGPGSEP ATSGSETPGSEPATSGSETPGSPAGSPTSTEEGTSTEPSEGSAPGTSTEP SEGSAPGSEPATSGSETPGTSESAGEPEA |
| 1005 (AC2591)* | ASHHHHHHSPAGSPTSTEEGTSESATPESGPGTSTEPSEGSAPGTSESAT PESGPGSEPATSGSETPGTSESATPESGPGSEPATSGSETPGTSESATPE SGPGTSTEPSEGSAPGSPAGSPTSTEEGTSESATPESGPGSEPATSGSET PGTSESATPESGPGSPAGSPTSTEEGSPAGSPTSTEEGTSTEPSEGSAPG TSESATPESGPGTSESATPESGPGTSESATPESGPGSEPATSGSETPGSE PATSGSETPGSPAGSPTSTEEGTSTEPSEGSAPGTSTEPSEGSAPGGSAP EAGRSANHTPAGLTGPATSGSETPGTEVQLVESGGGSVQAGGSLSLSCVA SGRTFGIYVMGWFRQAPGKEREFVAAISWSGSNRLVSDSVKGRFTISREN AKNTIYLQMNGLKPEDTANYFCAASNRLYGRTWYDFNESDYWGQGTQVT VSSGGGGSGGGSELVVTQEPSLTVSPGGTVTLTCRSSNGAVTSSNYANW VQQKPGQAPRGLIGGTNKRAPGTPARFSGSLLGGKAALTLSGVQPEDEAV YYCALWYPNLWVFGGGTKLTVLGATPPETGAETESPGETTGGSAESEPPG EGEVQLLESGGGIVQPGGSLKLSCAASGFTFNTYAMNWVRQAPGKGLEW VARIRSKYNNYATYYADSVKDRFTISRDDSKNTVYLQMNNLKTEDTAVYYC VRHENFGNSYVSWFAHWGQGTLVTVSSGTAEAASASGEAGRSANHTPAG LTGPPGSPAGSPTSTEEGTSESATPESGPGTSTEPSEGSAPGSPAGSPTS TEEGTSTEPSEGSAPGTSTEPSEGSAPGTSESATPESGPGSEPATSGSET PGSEPATSGSETPGSPAGSPTSTEEGTSESATPESGPGTSTEPSEGSAPG TSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTE PSEGSAPGTSTEPSEGSAPGTSESATPESGPGTSESATPESGPGSPAGSP TSTEEGTSESATPESGPGSEPATSGSETPGTSESATPESGPGTSTEPSEG SAPGTSTEPSEGSAPGTSTEPSEGSAPGTSTEPSEGSAPGTSTEPSEGSA PGTSTEPSEGSAPGSPAGSPTSTEEGTSTEPSEGSAPGTSESATPESGPG SEPATSGSETPGTSESATPESGPGSEPATSGSETPGTSESATPESGPGTS TEPSEGSAPGTSESATPESGPGSPAGSPTSTEEGSPAGSPTSTEEGSPAG SPTSTEEGTSESATPESGPGTSTEPSEGSAPGAAEPEA |
| 1006 (AC3353)* | ASHHHHHHATPESGPGSPAGSPTSTEEGSPAGSPTSTEEGTSTEPSEGSA PGTSESATPESGPGTSESATPESGPGTSESATPESGPGSEPATSGSETPG SEPATSGSETPGSPAGSPTSTEEGTSTEPSEGSAPGTSTEPSEGSAPGGS APEAGRSANHTPAGLTGPATSGSETPGTQVQLVESGGGVVQPGRSLRLSC AASGRTFGIYVMGWVRQAPGKEREFVAAISWSGSNRLVSDSVKGRFTISR DNSKNTLYLQMNSLRAEDTAVYYCAASNRLYGRTWYDFNESDYWGQGTQ VTVSSGGGGSELVVTQEPSLTVSPGGTVTLTCRSSNGAVTSSNYANWVQQ KPGQAPRGLIGGTNKRAPGTPARFSGSLLGGKAALTLSGVQPEDEAVYYC ALWYPNLWVFGGGTKLTVLGATPPETGAETESPGETTGGSAESEPPGEGE VQLLESGGGIVQPGGSLKLSCAASGFTFNTYAMNWVRQAPGKGLEWVARI RSKYNNYATYYADSVKDRFTISRDDSKNTVYLQMNNLKTEDTAVYYCVRHE |

TABLE D-continued

Exemplary amino acid sequences of polypeptides

| SEQ ID NO | AMINO ACID SEQUENCE |
|---|---|
| | NFGNSYVSWFAHWGQGTLVTVSSGTAEAASASGEAGRSANHTPAGLTGP ESATPESGPGSEPATSGSETPGTSESATPESGPGSEPATSGSETPGTSES ATPESGPGTSTEPSEGSAPGTSESATPESGPGSPAGSPTSTEEGSPAGSP TSTEEGSPAGSPTSTEEGTSESATPESGPGTSTEPSEGSAPGAAEPEA |
| 1007 (AC3354)* | ASHHHHHHATPESGPGSPAGSPTSTEEGSPAGSPTSTEEGTSTEPSEGSA PGTSESATPESGPGTSESATPESGPGTSESATPESGPGSEPATSGSETPG SEPATSGSETPGSPAGSPTSTEEGTSTEPSEGSAPGTSTEPSEGSAPGGS APEAGRSANHTPAGLTGPATSGSETPGTQVQLVESGGGVVQPGRSLRLSC AASGRTFGIYVMGWVRQAPGKEREFVAAISWSGSNRLVSDSVKGRFTISR DNSKNTLYLQMNSLRAEDTAVYYCAASNRLYGRTWYDFNESDYWGQGTQ VTVSSGATPPETGAETESPGELVVTQEPSLTVSPGGTVTLTCRSSNGAVTS SNYANWVQQKPGQAPRGLIGGTNKRAPGTPARFSGSLLGGKAALTLSGVQ PEDEAVYYCALWYPNLWVFGGGTKLTVLGATPPETGAETESPGETTGGSA ESEPPGEGEVQLLESGGGIVQPGGSLKLSCAASGFTFNTYAMNWVRQAPG KGLEWVARIRSKYNNYATYYADSVKDRFTISRDDSKNTVYLQMNNLKTEDT AVYYCVRHENFGNSYVSWFAHWGQGTLVTVSSGTAEAASASGEAGRSAN HTPAGLTGPESATPESGPGSEPATSGSETPGTSESATPESGPGSEPATSG SETPGTSESATPESGPGTSTEPSEGSAPGTSESATPESGPGSPAGSPTST EEGSPAGSPTSTEEGSPAGSPTSTEEGTSESATPESGPGTSTEPSEGSAP GAAEPEA |
| 1008 (AC3356)* | ASHHHHHHATPESGPGSPAGSPTSTEEGSPAGSPTSTEEGTSTEPSEGSA PGTSESATPESGPGTSESATPESGPGTSESATPESGPGSEPATSGSETPG SEPATSGSETPGSPAGSPTSTEEGTSTEPSEGSAPGTSTEPSEGSAPGGS APEAGRSANHTPAGLTGPATSGSETPGTQVQLVESGGGVVQPGRSLRLSC AASGRTFGIYVMGWVRQAPGKEREFVAAISWSGSNRLVSDSVKGRFTISR DNSKNTLYLQMNSLRAEDTAVYYCAASNRLYGRTWYDFNESDYWGQGTQ VTVSSGGGGSGGGSEVQLLESGGGIVQPGGSLKLSCAASGFTFNTYAMN WVRQAPGKGLEWVARIRSKYNNYATYYADSVKDRFTISRDDSKNTVYLQM NNLKTEDTAVYYCVRHENFGNSYVSWFAHWGQGTLVTVSSGATPPETGA ETESPGETTGGSAESEPPGEGELVVTQEPSLTVSPGGTVTLTCRSSNGAV TSSNYANWVQQKPGQAPRGLIGGTNKRAPGTPARFSGSLLGGKAALTLSG VQPEDEAVYYCALWYPNLWVFGGGTKLTVLGTAEAASASGEAGRSANHTP AGLTGPESATPESGPGSEPATSGSETPGTSESATPESGPGSEPATSGSET PGTSESATPESGPGTSTEPSEGSAPGTSESATPESGPGSPAGSPTSTEEG SPAGSPTSTEEGSPAGSPTSTEEGTSESATPESGPGTSTEPSEGSAPGAA EPEA |
| 1009 (AC3329)* | ASHHHHHHATPESGPGSPAGSPTSTEEGSPAGSPTSTEEGTSTEPSEGSA PGTSESATPESGPGTSESATPESGPGTSESATPESGPGSEPATSGSETPG SEPATSGSETPGSPAGSPTSTEEGTSTEPSEGSAPGTSTEPSEGSAPGGS APEAGRSANHTPAGLTGPRAPPEPEFARATSGSETPGTQVQLVESGGGWV QPGRSLRLSCAASGRTFGIYVMGWVRQAPGKEREFVAAISWSGSNRKVSD SVKGRFTISRDNSKNTLYLQMNSLRAEDTAVYYCAASNRLYGRTWYDFNE SDYWGQGTQVTVSSGGGGSGGGSELVVTQEPSLTVSPGGTVTLTCRSSN GAVTSSNYANWVQQKPGQAPRGLIGGTNKRAPGTPARFSGSLLGGKAALT LSGVQPEDEAVYYCALWYPNLWVFGGGTKLTVLGATPPETGAETESPGET TGGSAESEPPGEGEVQLLESGGGIVQPGGSLKLSCAASGFTFNTYAMNWV RQAPGKGLEWVARIRSKYNNYATYYADSVKDRFTISRDDSKNTVYLQMNN LKTEDTAVYYCVRHENFGNSYVSWFAHWGQGTLVTVSSGTAEAASASGE AGRSANHTPAGLTGPESATPESGPGSEPATSGSETPGTSESATPESGPGS EPATSGSETPGTSESATPESGPGTSTEPSEGSAPGTSESATPESGPGSPA GSPTSTEEGSPAGSPTSTEEGSPAGSPTSTEEGTSESATPESGPGTSTEP SEGSAPGAAEPEA |

*The HHHHHH (SEQ ID NO: 48) sequence within this amino acid sequence is dispensable and can be removed. A sequence with the HHHHHH (SEQ ID NO: 48) removed is expressly disclosed herein as well.

Recombinant Production

Also provided are polynucleotides that encode any polypeptide disclosed herein and/or the reverse complements of such polynucleotides.

The disclosure herein includes an expression vector that comprises a polynucleotide sequence, such as any described in the preceding paragraph, and a regulatory sequence operably linked to the polynucleotide sequence.

The disclosure herein includes a host cell comprising an expression vector, such as described any in the preceding paragraph. In some embodiments, the host cell is a prokaryote. In some embodiments, the host cell is E. coli. In some embodiments, the host cell is a mammalian cell.

In some embodiments, the disclosure provides methods of manufacturing the subject compositions. In some embodiments, such a method comprises culturing a host cell comprising a nucleic acid construct that encodes a polypeptide (such as a paTCE) described herein under conditions that promote the expression of the polypeptide, followed by recovery of the polypeptide using standard purification methods (e.g., column chromatography, HPLC, and the like) wherein the composition is recovered wherein at least 70%, or at least 80%, or at least 90%, or at least 95%, or at least 97%, or at least 99% of the binding fragments of the expressed polypeptide or paTCE fusion polypeptide are correctly folded. In some embodiments of the method of making, the expressed polypeptide is recovered in which at least or at least 90%, or at least 95%, or at least 97%, or at least 99% of the polypeptide is recovered in monomeric, soluble form.

In some embodiments, the disclosure relates to methods of making a polypeptide (such as a paTCE fusion polypeptide) at high fermentation expression levels of functional protein using an E. coli or mammalian host cell, as well as providing expression vectors encoding the polypeptides useful in methods to produce the cytotoxically active polypeptide compositions at high expression levels. In some embodiments, the method comprises the steps of 1) preparing a polynucleotide encoding a polypeptide disclosed herein, 2) cloning the polynucleotide into an expression vector, which can be a plasmid or other vector under the control of appropriate transcription and translation sequences for high level protein expression in a biological system, 3) transforming an appropriate host cell with the expression vector, and 4) culturing the host cell in conventional nutrient media under conditions suitable for the expression of the polypeptide composition. Where desired, the host cell is E. coli. As used herein, the term "correctly folded" means that the antigen binding fragments component of the composition have the ability to specifically bind their target ligands (e.g., upon activation). In some embodiments, the disclosure provides a method for producing a polypeptide, the method comprising culturing in a fermentation reaction a host cell that comprises a vector encoding a polypeptide comprising the polypeptide under conditions effective to express the polypeptide product.

Pharmaceutical Composition

Disclosed herein includes a pharmaceutical composition comprising a polypeptide (such as a paTCE), such as any described herein, and one or more pharmaceutically acceptable excipients. In some embodiments, the pharmaceutical composition is formulated for intradermal, subcutaneous, intravenous, intra-arterial, intraabdominal, intraperitoneal, intravitreal, intrathecal, or intramuscular administration. In some embodiments, the pharmaceutical composition is formulated for intravenous injection. In some embodiments, the pharmaceutical composition is in a liquid form or frozen. In some embodiments, the pharmaceutical composition is formulated as a lyophilized powder to be reconstituted prior to administration.

The pharmaceutical compositions can be administered for therapy by any suitable route. In some embodiments, the dose is administered intradermally, subcutaneously, intravenously, intra-arterially, intra-abdominally, intraperitoneally, intrathecally, or intramuscularly. In some embodiments, the subject is a mouse, rat, monkey, or human. In preferred embodiments, the subject is a human.

In some embodiments, the pharmaceutical composition can be administered subcutaneously, intramuscularly, or intravenously. In some embodiments, the pharmaceutical composition is administered at a therapeutically effective amount. In some embodiments, the therapeutically effective amount results in a gain in time spent within a therapeutic window for the fusion protein compared to the corresponding TCE of the fusion protein not linked to the ELNN and administered at a comparable dose to a subject.

In some embodiments, the pharmaceutical composition is administered subcutaneously. In some embodiments, the pharmaceutical composition is administered intravenously. In some embodiments, the composition may be supplied as a lyophilized powder or cake to be reconstituted prior to administration. In some embodiments, the composition may also be supplied in a liquid form or frozen, which can be administered directly to a subject.

Pharmaceutical Kits

In some embodiments, the present disclosure provides kits to facilitate the use of paTCEs. In some embodiments, a kit comprises (a) a first container comprising pharmaceutically effective amount of a paTCE in a lyophilized composition; and (b) a second container comprising a diluent for reconstituting the lyophilized formulation. In some embodiments, the kit further comprises instructions for storage of the kit, information regarding a cancer that is treatable with the paTCE, instructions for the reconstitution of the lyophilized formulation, and/or administration instructions.

Methods of Treatment

Disclosed herein are uses of a polypeptide, such as any described herein, in the preparation of a medicament for the treatment of a disease in a subject. In some embodiments, the particular disease to be treated will depend on the choice of the biologically active proteins. In some embodiments, the disease is cancer (including any form thereof). Included herein are paTCE polypeptides for use in the treatment of cancer. In some cases, the cancer or tumor expresses PSMA. In some embodiments, the cancer or tumor is a solid tumor. In some embodiments, the cancer is a carcinoma. In some embodiments, the carcinoma is a gastric carcinoma. In some embodiments, the carcinoma is a colorectal adenocarcinoma. In some embodiment, the carcinoma is a colon carcinoma The present disclosure includes a method of treating a disease in a subject, the method comprising administering to the subject in need thereof a therapeutically effective amount of the pharmaceutical composition, such as any described herein. In some embodiments, the disease is cancer. In some embodiments, the subject is a mouse, rat, monkey, or human. In some embodiments, the subject is a human.

In some embodiments, the cancer is prostate cancer. In some embodiments, the prostate cancer is metastatic prostate cancer. In some embodiments, the prostate cancer is androgen-independent. In some embodiments, the prostate cancer is non-metastatic castration-resistant prostate cancer (nmCRPC). In some embodiments, the prostate cancer is metastatic castration-resistant prostate cancer (mCRPC).

In some embodiments, a PSMA-targeted bispecific composition of the present disclosure (such as a paTCE) may be combined with a checkpoint inhibitors. In some embodiments of such combination therapy, a paTCE can be combined with an antagonist of the cell surface receptor programmed cell death protein 1, also known as PD-1, and/or an antagonist of PD-L1.

PD-1 plays an important role in down-regulating the immune system and promoting self-tolerance by suppressing T cell inflammatory activity. Binding of the PD-1 ligands, PD-L1 and PD-L2 to the PD-1 receptor found in T cells inhibits T-cell proliferation and cytokine production. Upregulation of PD-1 ligands occurs in some tumors and signaling through this pathway can contribute to inhibition of active T-cell immune surveillance of tumors. Anti-PD-1 antibodies bind to the PD-1 receptor and block its interaction with PD-L1 and PD-L3, releasing PD-1 pathway-mediated inhibition of the immune response, including the anti-tumor immune response.

Those of skill in the art are aware of various anti-PD-1 antibodies that may be used. In some embodiments, an exemplary anti-PD-1 antibody used in combination with the compounds of the present invention is Pembrolizumab (Keytruda®). In some embodiments, the anti-PD-1 antibody used in combination with the compound described above is Nivolumab (Opdivo®). In some embodiments, the anti-PD-1 antibody used in combination with the compound described above is Pidilizumab (Medivation).

Additional PD-1 antibodies known to those of skill in the art, include AGEN-2034 (Agenus), AMP-224 (Medimmune), BCD-100 (Biocad), BGBA-317 (Beigene), BI-754091 (Boehringer Ingelheim), CBT-501 (Genor Biopharma), CC-90006 (Celgene), cemiplimab (Regeneron Pharmaceuticals), durvalumab+MEDI-0680 (Medimmune), GLS-010 (Harbin Gloria Pharmaceuticals), IBI-308 (Eli Lilly), JNJ-3283 (Johnson & Johnson), JS-001 (Shanghai Junshi Bioscience Co.), MEDI-0680 (Medimmune), MGA-012 (MacroGenics), MGD-013 (Marcogenics), pazopanib hydrochloride+pembrolizumab (Novartis), PDR-001 (Novartis), PF-06801591 (Pfizer), SHR-1210 (Jiangsu Hengrui Medicine Co.), TSR-042 (Tesaro Inc.), LZM-009 (Livzon Pharmaceutical Group Inc) and ABBV-181 (AbbVie Inc).

In some embodiments for combination therapy of the present disclosure, the anti-PD-1 antibody is pembrolizumab (Keytruda®).

In some embodiments, the compositions of the present invention are combined with an anti-PD-L1 antibody. Exemplary such anti-PD-L1 antibodies used in the combinations of the present invention may be selected from the group consisting of Durvalumab (MedImmune LLC), Atezolizumab (Hoffmann-La Roche Ltd, Chugai Pharmaceutical Co Ltd), Avelumab (Merck KGaA), CX-072 (CytomX Therapeutics Inc), BMS-936559 (ViiV Healthcare Ltd), SHR-1316 (Jiangsu Hengrui Medicine Co Ltd), M-7824 (Merck KGaA), LY-3300054 (Eli Lilly and Co), FAZ-053 (Novartis AG), KN-035 (AlphaMab Co Ltd), CA-170 (Curis Inc), CK-301 (TG Therapeutics Inc), CS-1001 (CStone Pharmaceuticals Co Ltd), HLX-10 (Shanghai Henlius Biotech Co Ltd), MCLA-145 (Merus NV), MSB-2311 (MabSpace Biosciences (Suzhou) Co Ltd) and MEDI-4736 (Medimmune).

Other immunotherapies and checkpoint inhibitor-based therapies that may be useful in combination with the compositions of the present disclosure include CTLA4, TIGIT, OX40, and TIM3-based therapies.

In some embodiments, the disclosure provides a method of treating cancer in a subject in need thereof, the method comprising administering to the subject an amount of the paTCE described herein to the subject, and a checkpoint inhibitor to the subject, wherein the cancer comprises a solid tumor, and treating the cancer comprises reducing the volume of the solid tumor.

Exemplary Embodiments

Disclosed herein further provides below non-limiting exemplary embodiments:

1. A chimeric polypeptide comprising a bispecific antibody domain,
    wherein the bispecific antibody domain comprises a first antigen binding domain that specifically binds to prostate-specific membrane antigen (PSMA) and a second antigen binding domain that binds to cluster of differentiation 3 T cell receptor (CD3),
    wherein
    the first antigen binding domain is a VHH; or
    the second antigen binding domain is a Fab or an scFV, and
    wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or PSMA, and wherein the protease-cleavable release segment is cleavable by at least one protease that is present in a tumor.

2. A chimeric polypeptide comprising a bispecific antibody domain,
    wherein the bispecific antibody domain comprises a first antigen binding domain that specifically binds to prostate-specific membrane antigen (PSMA) and a second antigen binding domain that binds to cluster of differentiation 3 T cell receptor (CD3),
    wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or PSMA, wherein the protease-cleavable release segment is not capable of being cleaved by legumain in human plasma, or wherein legumain cleaves the protease-cleavable release segment in human plasma at a rate that is less than about 25% of the rate that RSR-2295 (EAGRSANHTPAGLTGP) (SEQ ID NO: 7048) is cleaved by legumain.

3. The chimeric polypeptide of embodiment 1 or 2, which comprises a structural arrangement from the N-terminal side to the C-terminal side defined as: (first antigen binding domain)-(second antigen binding domain)-(linker)-(mask polypeptide), (second antigen binding domain)-(first antigen binding domain)-(linker)-(mask polypeptide), (mask polypeptide)-(linker)-(first antigen binding domain)-(second antigen binding domain), or (mask polypeptide)-(linker)-(second antigen binding domain)-(first antigen binding domain), wherein each—is a covalent connection or a polypeptide linker.

4. The chimeric polypeptide of any one of the above embodiments, wherein the mask polypeptide is an extended length non-natural polypeptide (ELNN).

5. The chimeric polypeptide of any one of the above embodiments, wherein the linker further comprises a spacer.

6. The chimeric polypeptide of any one of the above embodiments, wherein the protease-cleavable release segment is fused to the bispecific antibody domain via the spacer.

7. The chimeric polypeptide of embodiment 5 or 6 wherein the spacer is characterized in that:
    (i) at least 90% of its amino acids are glycine (G), alanine (A), serine (S), threonine (T), glutamate (E), proline (P), or any combination thereof; and
    (ii) it comprises at least 3 types of amino acids selected from the group consisting of G, A, S, T, E, and P.

8. The chimeric polypeptide of any one of embodiments 5 to 7, wherein the spacer is from 9 to 14 amino acids in length.

9. The chimeric polypeptide of any one of embodiments 5 to 8, wherein the spacer comprises at least 4 types of amino acids selected from the group consisting of G, A, S, T, E, and P.

10. The chimeric polypeptide of any one of embodiments 5 to 9, wherein the amino acids of the spacer consist of A, E, G, S, P, and/or T.

11. The chimeric polypeptide of any one of embodiments 5 to 10, wherein the spacer is cleavable by a non-mammalian protease.

12. The chimeric polypeptide of embodiment 11, wherein the non-mammalian protease is Glu-C.

13. The chimeric polypeptide of any one of embodiments 5 to 12, wherein the spacer comprises an amino acid sequence having at least 85%, 90%, 91%, 92%, 93%, 94%, 95%, 96%, 97%, 98%, or 99% identity, or 100% identity, to a sequence listed in Table C.

14. The chimeric polypeptide of any one of embodiments 5 to 13, wherein the spacer comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or

```
                                       (SEQ ID NO: 96)
GTSESATPES
or (SEQ ID NO: 97)
GTATPESGPG.
```

15. The chimeric polypeptide of any one of embodiments 1 to 14, wherein the protease-cleavable release segment comprises an amino acid sequence comprising the sequence: EAGRSAXHTPAGLTGP (SEQ ID NO: 7627), wherein X is any amino acid other than N.

16. The chimeric polypeptide of embodiment 15, wherein X is S.

17. The chimeric polypeptide of embodiment 1 or 2, comprising
a first mask polypeptide joined to the first antigen binding domain via a first linker wherein the first linker comprises a first protease cleavable release segment (RS1) cleavable by at least one protease present in a tumor; and
a second mask polypeptide joined to the second antigen binding domain via a second linker wherein the second linker comprises a second protease cleavable release segment (RS2) cleavable by at least one protease present in a tumor.

18. The chimeric polypeptide of embodiment 17, which comprises a structural arrangement from the N-terminal side to the C-terminal side defined as: (Mask1)-(Linker1)-(first antigen binding domain)-(second antigen binding domain)-(Linker2)-(Mask2), (Mask1)-(Linker1)-(second antigen binding domain)-(first antigen binding domain)-(Linker2)-(Mask2), (Mask2)-(Linker2)-(first antigen binding domain)-(second antigen binding domain)-(Linker1)-(Mask1), or (Mask2)-(Linker2)-(second antigen binding domain)-(first antigen binding domain)-(Linker1)-(Mask1), wherein each—is, individually, a covalent bond or a polypeptide linker.

19. The chimeric polypeptide of embodiment 17 or 18, wherein the first mask polypeptide is a first ELNN (ELNN1) and the second mask polypeptide is a second ELNN (ELNN2).

20. The chimeric polypeptide of embodiment 19, which comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

21. The chimeric polypeptide of any one of embodiments 17-20, wherein Linker1 further comprises a first spacer (Spacer1).

22. The chimeric polypeptide of any one of embodiments 17-21, wherein Linker2 further comprises a second spacer (Spacer2).

23. The chimeric polypeptide of embodiment 21 or 22, wherein RS1 is fused to the bispecific antibody domain via Spacer1 and/or RS2 is fused to the bispecific antibody domain via Spacer2.

24. The chimeric polypeptide of embodiment 23, which comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS2)-(Spacer2)-(first antigen binding domain)-(second antigen binding domain)-(Spacer1)-(RS1)-(ELNN1), or (ELNN2)-(RS2)-(Spacer2)-(second antigen binding domain)-(first antigen binding domain)-(Spacer1)-(RS1)-(ELNN1), wherein each—is a, individually, covalent bond or a polypeptide linker.

25. The chimeric polypeptide of any one of embodiments 21-24 wherein Spacer1 and/or the Spacer2 is characterized in that:
(1) at least 90% of its amino acids are glycine (G), alanine (A), serine (S), threonine (T), glutamate (E), proline (P), or any combination thereof; and
(ii) it comprises at least 3 types of amino acids selected from the group consisting of G, A, S, T, E, and P.

26. The chimeric polypeptide of any one of embodiments 21-25, wherein Spacer1 and/or the Spacer2 is from 9 to 14 amino acids in length.

27. The chimeric polypeptide of any one of embodiments 21-26, wherein Spacer1 and/or the Spacer2 comprises at least 4 types of amino acids selected from the group consisting of G, A, S, T, E, and P.

28. The chimeric polypeptide of any one of embodiments 21-27, wherein the amino acids of Spacer1 and/or the Spacer2 consists of A, E, G, S, P, and/or T.

29. The chimeric polypeptide of any one of embodiments 21-28, wherein Spacer1 and/or the Spacer2 comprises an amino acid sequence having at least 85%, 90%, 91%, 92%, 93%, 94%, 95%, 96%, 97%, 98%, or 99% identity, or 100% identity, to a sequence listed in Table C.

30. The chimeric polypeptide of any one of embodiments 21-29, wherein Spacer1 and/or the Spacer2 comprises an amino acid sequence that has at least 85%, 90%, 91%, 92%, 93%, 94%, 95%, 96%, 97%, 98%, or 99% identity, or 100% identity, to GTSESATPES (SEQ ID NO: 96) or GTATPESGPG (SEQ ID NO: 97).

31. The chimeric polypeptide of any one of embodiments 19-30, wherein the amino acid sequence of the first ELNN is between 250 amino acids and 350 amino acids in length, and wherein the amino acid sequence of the second ELNN is between 500 amino acids and 600 amino acids in length.

32. The chimeric polypeptide of any one of embodiments 19-31, wherein the amino acid sequence of the first ELNN is 294 amino acids in length, and wherein the amino acid sequence of the second ELNN is 582 amino acids in length.

33. The chimeric polypeptide of any one of embodiments 17-32, wherein RS1 and/or RS2 comprises an amino acid sequence comprising the sequence: EAGRSAXHTPAGLTGP (SEQ ID NO: 7627), wherein X is any amino acid other than N.

34. The chimeric polypeptide of embodiment 33, wherein X is S.

35. A chimeric polypeptide comprising a bispecific antibody domain, wherein the bispecific antibody domain comprises a first antigen binding domain that has binding specificity to a cancer cell antigen, and a second antigen binding domain that has binding specificity to an effector cell antigen expressed on an effector cell, wherein the chimeric polypeptide further comprises a first ELNN joined to the first antigen binding domain via a first linker comprising a first protease-cleavable release segment (RS1) positioned between the first ELNN and the first antigen binding domain such that the first ELNN is capable of reducing the binding of the first antigen binding domain to the cancer cell antigen, wherein the RS1 is cleavable by at least one protease that is present in a tumor, wherein the chimeric polypeptide further comprises a second ELNN joined to the second antigen binding domain via a second linker comprising second protease-cleavable release segment (RS2) positioned between the second ELNN and the second antigen binding domain such that the second ELNN is capable of reducing the binding of the first antigen binding domain to the effector cell antigen, wherein the RS2 is cleavable by at least one protease that is present in a tumor, wherein the first ELNN has a shorter amino acid sequence than the second ELNN, and wherein the cancer cell antigen is not HER2.

36. The chimeric polypeptide of embodiment 35, which comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

37. The chimeric polypeptide of any one of embodiments 3-36, wherein each—is a covalent bond.

38. The chimeric polypeptide of any one of embodiments 3-37, wherein each—is a peptide bond.

39. The chimeric polypeptide of any one of embodiments 36-38, wherein Linker1 further comprises a first spacer (Spacer1).

40. The chimeric polypeptide of any one of embodiments 36-38, wherein Linker2 further comprises a second spacer (Spacer2).

41. The chimeric polypeptide of embodiment 39 or 40, wherein RS1 is fused to the bispecific antibody domain via Spacer1 and/or RS2 is fused to the bispecific antibody domain via Spacer2.

42. The chimeric polypeptide of embodiment 41, which comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS2)-(Spacer2)-(first antigen binding domain)-(second antigen binding domain)-(Spacer1)-(RS1)-(ELNN1), or (ELNN2)-(RS2)-(Spacer2)-(second antigen binding domain)-(first antigen binding domain)-(Spacer1)-(RS1)-(ELNN1), wherein each—is a, individually, covalent bond or a polypeptide linker.

43. The chimeric polypeptide of embodiment 42, wherein each—is a covalent bond.

44. The chimeric polypeptide of embodiment 42, wherein each—is a peptide bond.

45. The chimeric polypeptide of any one of embodiments 1-44, further comprising an antibody domain linker between the first antigen binding domain and the second antigen binding domain.

46. A chimeric polypeptide comprising a bispecific antibody domain, comprising the formulas that comprises from the N-terminal side to the C-terminal side:

(Mask1)-(RS1)-(Spacer1)-(first antigen binding domain)-[antibody domain linker]-(second antigen binding domain);　　　　Formula 1:

(first antigen binding domain)-[antibody domain linker]-(second antigen binding domain)-(Spacer2)-(RS2)-(Mask2);　　　　Formula 2: or (Mask1)-(RS1)-(Spacer1)-(first antigen binding domain)-[antibody domain linker]-(second antigen binding domain)-(Spacer2)-(RS2)-(Mask2),　　　　Formula 3:

wherein, the first antigen binding domain has binding specificity to a cancer cell antigen;

the second antigen binding domain has binding specificity to an effector cell antigen expressed on an effector cell;

each—comprises, individually, a covalent connection or a polypeptide linker;

the Mask1 is a polypeptide that is capable of reducing binding of the first antigen binding domain to its target;

the Mask2 is a polypeptide that is capable of reducing binding of the second antigen binding domain to its target;

if the chimeric polypeptide comprises Formula 1 then the Spacer1 consists of A, E, G, S, P, and/or T residues, if the chimeric polypeptide comprises Formula 2 then the Spacer2 consists of A, E, G, S, P, and/or T residues, and if the chimeric polypeptide comprises Formula 3 then the Spacer1 and/or the Spacer2 consists of A, E, G, S, P, and/or T residues; and wherein the cancer cell antigen is not HER2.

47. The chimeric polypeptide of any one of embodiments 3-46, wherein each—is, individually, a covalent connection.

48. The chimeric polypeptide of embodiment 47, wherein each—is, individually, a covalent bond.

49. The method of embodiment 47, wherein each—is a peptide bond.

50. The chimeric polypeptide of embodiment 29, wherein each—is, individually, a polypeptide linker of no more than 5 amino acids.

51. The chimeric polypeptide of any one of embodiments 35-50, wherein the cancer cell antigen is human alpha 4 integrin, Ang2, B7-H3, B7-H6, CEACAM5, cMET, CTLA4, FOLR1, EpCAM, CCR5, CD19, HER3, HER4, PD-L1, prostate-specific membrane antigen (PSMA), CEA, MUC1 (mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MIS-IIR), sialylated Tn antigen (sTN), fibroblast activation antigen (FAP), endosialin (CD248), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, or EphA2.

52. The chimeric polypeptide of any one of embodiments 35-51, wherein the cancer cell antigen is PSMA.
53. The chimeric polypeptide of any one of embodiments 35-52, wherein the effector cell antigen is cluster of differentiation 3 T cell receptor (CD3).
54. The chimeric polypeptide of any one of embodiments 1-53, wherein the second antigen binding domain has binding specificity to human CD3 and cynomolgus monkey CD3.
55. The chimeric polypeptide of any one of embodiments 1-54, wherein the second antigen binding domain has binding specificity to human CD3.
56. The chimeric polypeptide of any one of embodiments 53-55, wherein the CD3 is CD3 epsilon, CD3 delta, CD3 gamma, or CD3 zeta.
57. The chimeric polypeptide of embodiment 56, wherein the effector cell antigen is CD3 epsilon.
58. The chimeric polypeptide of any one of embodiments 46-57, wherein the Mask1 is a first ELNN and the Mask2 is a second ELNN.
59. The chimeric polypeptide of any one of embodiments 46-58, wherein the Spacer1 and/or the Spacer2 is characterized in that:
   (i) at least 90% of its amino acids are glycine (G), alanine (A), serine (S), threonine (T), glutamate (E), proline (P), or any combination thereof; and
   (ii) it comprises at least 3 types of amino acids selected from the group consisting of G, A, S, T, E, and P.
60. The chimeric polypeptide of embodiment 59, wherein the Spacer1 and/or the Spacer2 is from 9 to 14 amino acids in length.
61. The chimeric polypeptide of embodiment 59 or 60, wherein the Spacer1 and/or the Spacer2 comprises at least 4 types of amino acids selected from the group consisting of G, A, S, T, E, and P.
62. The chimeric polypeptide of any one of embodiments 59-61, wherein the amino acids of the Spacer1 and/or the Spacer2 consists of A, E, G, S, P, and/or T.
63. The chimeric polypeptide of any one of embodiments 59-62, wherein the Spacer1 and/or the Spacer2 is cleavable by a non-mammalian protease.
64. The chimeric polypeptide of embodiment 63, wherein the non-mammalian protease is Glu-C.
65. The chimeric polypeptide of any one of embodiments 59-64, wherein the Spacer1 and/or the Spacer 2 comprises an amino acid sequence having at least 85%, 90%, 91%, 92%, 93%, 94%, 95%, 96%, 97%, 98%, or 99% identity, or 100% identity, to a sequence listed in Table C.
66. The chimeric polypeptide of any one of embodiments 59-65, wherein the Spacer1 and/or the Spacer 2 comprises an amino acid sequence that has at least 85%, 90%, 91%, 92%, 93%, 94%, 95%, 96%, 97%, 98%, or 99% identity, or 100% identity, to GTSESATPES (SEQ ID NO: 96) or GTATPESGPG (SEQ ID NO: 97).
67. The chimeric polypeptide of any one of embodiments 35-66, wherein the amino acid sequence of the first ELNN is at least 100 amino acids shorter than the amino acid sequence of the second ELNN.
68. The chimeric polypeptide of embodiment 67, wherein the amino acid sequence of the first ELNN is at least 200 amino acids shorter than the amino acid sequence of the second ELNN.
69. The chimeric polypeptide of embodiment 67 or 68, wherein the amino acid sequence of the first ELNN is at least 250 amino acids shorter than the amino acid sequence of the second ELNN.
70. The chimeric polypeptide of any one of embodiments 35-69, wherein the amino acid sequence of the first ELNN is about 294 amino acids in length, and wherein the amino acid sequence of the second ELNN is about 582 amino acids in length.
71. The chimeric polypeptide of any one of embodiments 1-70, wherein the first antigen binding domain comprises a first antibody or an antigen-binding fragment thereof, and wherein the second antigen binding domain is a second antibody or an antigen-binding fragment thereof.
72. The chimeric polypeptide of any one of embodiments 1-71, wherein the first antigen binding domain is a Fab, an scFV, or an ISVD.
73. The chimeric polypeptide of embodiment 72, wherein the ISVD is a VHH domain.
74. The chimeric polypeptide of any one of embodiments 1-73, wherein the second antigen binding domain is a Fab, an scFV, or an ISVD.
75. The chimeric polypeptide of embodiment 74, wherein the ISVD is a VHH domain.
76. The chimeric polypeptide of any one of embodiments 1-75, wherein the first antigen binding domain is a VHH domain.
77. The chimeric polypeptide of any one of embodiments 1-76, wherein the second antigen binding domain is an scFV.
78. The chimeric polypeptide of any one of embodiments 1-77, wherein there is an antibody domain linker between the first antigen binding domain and the second antigen binding domain.
79. The chimeric polypeptide of embodiment 78, wherein the antibody domain linker comprises an amino acid sequence having at least 85%, 90%, 91%, 92%, 93%, 94%, 95%, 96%, 97%, 98%, or 99% identity, or 100% identity, to a sequence listed in Table A or B.
80. The chimeric polypeptide of embodiment 78, wherein the antibody domain linker consists of G and S amino residues.
81. The chimeric polypeptide of embodiment 78 or 79, wherein the antibody domain linker is about 9 residues in length.

82. The chimeric polypeptide of embodiment 80 or 81, wherein the antibody domain linker comprises the amino acid sequence GGGGSGGGS (SEQ ID NO: 125).

83. The chimeric polypeptide of any one of embodiments 1-82, wherein the scFv comprises a VL domain, a VH domain, and a linker between the VL domain and the VH domain, wherein the linker consists of A, E, G, S, P, and/or T residues.

84. The chimeric polypeptide of embodiment 83, wherein the linker is characterized in that:
   (i) at least 90% of its amino acids are glycine (G), alanine (A), serine (S), threonine (T), glutamate (E), proline (P), or any combination thereof; and
   (ii) it comprises at least 3 types of amino acids selected from the group consisting of G, A, S, T, E, and P.

85. The chimeric polypeptide of embodiment 83 or 84, wherein the linker between the VL domain and the VH domain is from 25 to 35 amino acids in length.

86. The chimeric polypeptide of any one of embodiments 83-85, wherein the linker between the VL domain and the VH domain comprises at least 4 types of amino acids selected from the group consisting of G, A, S, T, E, and P.

87. The chimeric polypeptide of any one of embodiments 83-86, wherein the amino acids of the linker between the VL domain and the VH domain consists of A, E, G, S, P, and/or T.

88. The chimeric polypeptide of any one of embodiments 83-87, wherein the linker between the VL domain and the VH domain is cleavable by a non-mammalian protease.

89. The chimeric polypeptide of embodiment 88, wherein the non-mammalian protease is Glu-C.

90. The chimeric polypeptide of embodiment 89, wherein linker between the VL domain and the VH domain comprises an amino acid sequence that has at least 85%, 90%, 91%, 92%, 93%, 94%, 95%, 96%, 97%, 98%, or 99% identity, or 100% identity, to SESATPESGPGTSPGATPESGPGTSESATP (SEQ ID NO: 81).

91. The chimeric polypeptide of any one of embodiments 1-90, wherein the first antigen binding domain comprises a VHH domain comprising three VHH complementarity determining regions (CDRs), wherein the three VHH CDRs comprise the CDR1, CDR2, and CDR3 of a VHH domain comprising the following amino acid sequence:

(SEQ ID NO: 549)
QVQLVESGGGVVQPGRSLRLSCAASGRTFGIYVWGWFRQAPGKEREFVG

AMSWSGSNRKVSDSVKGRFTISRDNSKNTLYLQMNSLRAEDTAVYYCAA

SNKEYGRTWYDFNESDYWGQGTQVTVSS.

92. The chimeric polypeptide of any one of embodiments 1-91, wherein the second antigen binding domain comprises a VL domain comprising three the VL CDRs, wherein the three VL CDRs comprise the CDR1, CDR2, and CDR3 of a VL domain comprising the following amino acid sequence:

(SEQ ID NO: 9001)
ELVVTQEPSLTVSPGGTVTLTCRSSX$_1$GAVTX$_2$SNYANWVQQKPGQAPRG

LIGGTNKRAPGTPARFSGSLLGGKAALTLSGVQPEDEAX$_3$YYCALWYX$_4$N

LWVFGGGTKLTVL, wherein X$_1$ corresponds to T or N, X$_2$ corresponds to T or S, X$_3$ corresponds to E or V, and X$_4$ corresponds to S or P.

93. The chimeric polypeptide of any one of embodiments 1-92, wherein the second antigen binding domain comprises a VL domain comprising three the VL CDRs, wherein the three VL CDRs comprise the CDR1, CDR2, and CDR3 of a VL domain comprising the following amino acid sequence:

(SEQ ID NO: 361)
ELVVTQEPSLTVSPGGTVTLTCRSSNGAVTSSNYANWVQQKPGQAPRGLI

GGTNKRAPGTPARFSGSLLGGKAALTLSGVQPEDEAVYYCALWYPNLWVF

GGGTKLTVL.

94. The chimeric polypeptide of any one of embodiments 1-91, wherein the second antigen binding domain comprises a VH domain comprising three the VH CDRs, wherein the three VH CDRs comprise the CDR1, CDR2, and CDR3 of a VH domain comprising the following amino acid sequence:
EVQLX$_5$ESGGGX$_6$VQPGGSLX$_7$LSCAASGFTFX$_8$TYAMNWVRQAPGKGLE YATYYADSVKX$_{12}$RFTISRDDSKNTX$_{13}$YLQMNX$_{14}$LKTEDTAVYYCVRH (SEQ ID NO:9002), wherein X$_5$ corresponds to V or L, X$_6$ corresponds to I or L, X$_7$ corresponds to R or K, X$_8$ corresponds to S or N, X$_9$ corresponds to G or A, X$_{10}$ corresponds to T or S, X$_{11}$ corresponds to R or Y, X$_{12}$ corresponds to G or D, X$_{13}$ corresponds to V or A, X$_{14}$ corresponds to S or N, X$_{15}$ corresponds to E or G, and X$_{16}$ corresponds to H or Y.

95. The chimeric polypeptide of any one of embodiments 1-91, wherein the second antigen binding domain comprises a VH domain comprising three the VH CDRs, wherein the three VH CDRs comprise the CDR1, CDR2, and CDR3 of a VH domain comprising the following amino acid sequence:

(SEQ ID NO: 311)
EVQLVESGGGIVQPGGSLRLSCAASGFTFSTYAMNWVRQAPGKGLEWVGR

IRTKRNNYATYYADSVKGRFTISRDDSKNTVYLQMNSLKTEDTAVYYCVR

HENFGNSYVSWFAHWGQGTLVTVSS.

96. The chimeric polypeptide of any one of embodiments 1-91, wherein the second antigen binding domain comprises a VL domain amino acid sequence SEQ ID NO/VH domain amino acid sequence SEQ ID NO pair selected from the group consisting of: 896/897; 902/903; 700/701; 702/703; 716/717; 718/719; 728/729; 736/737; 738/739; 740/741; 742/743; 744/745; 746/747; 748/749; 750/751; 752/753; 754/755; 756/757; 758/759; 760/761; 762/763; 764/765; 766/767; 774/775; 776/777; 790/791; 792/793; 798/799; 800/801; 806/807; 808/809; 814/815; 816/817; 822/823; 824/825; or 826/867.

97. The chimeric polypeptide of any one of embodiments 1-96, wherein
(i) the first antigen binding domain is a VHH comprising the following CDRs:
   a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003);
a VHH CDR2 with an amino acid sequence that that has at least 85%, 90%, 91%, 92%, 93%, 94%, 95%, 96%, 97%, 98%, or 99% identity, or 100% identity, to AMSWSGSNRKVSDSVKG (SEQ ID NO:9004); and
a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005), and
(ii) and wherein the second antigen binding domain comprises the following CDRs:
a VL domain CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:9006), wherein X$_1$ corresponds to T or N, and X$_2$ corresponds to T or S;
a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4);
a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:9007), wherein X$_4$ corresponds to S or P;
a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:9008), wherein X$_8$ corresponds to S or N;
a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NNYATYYADSVKX$_{12}$ (SEQ ID NO:9009), wherein X$_{10}$ corresponds to T or S, X$_{11}$ corresponds to R or Y, and X$_{12}$ corresponds to G or D;
a VH domain CDR3 with an amino acid sequence that has at least 85%, 90%, 91%, 92%, 93%, 94%, 95%, 96%, 97%, 98%, or 99% identity, or 100% identity, to HX$_{15}$NFGNSYVSWFAX$_{16}$ (SEQ ID NO:9010), wherein X$_{15}$ corresponds to E or G, and X$_{16}$ corresponds to H or Y.

98. The chimeric polypeptide of any one of embodiments 1-97, wherein
(i) the first antigen binding domain is a VHH comprising the following CDRs:
a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003);
a VHH CDR2 with an amino acid sequence that that has at least 85%, 90%, 91%, 92%, 93%, 94%, 95%, 96%, 97%, 98%, or 99% identity, or 100% identity, to AMSWSGSNRKVSDSVKG (SEQ ID NO:9004); and
a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005), and
(ii) and wherein the second antigen binding domain comprises the following CDRs:
a VL domain CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1);
a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4);
a VL domain CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6);
a VH domain CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12);
a VH domain CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and
a VH domain CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO:10).

99. The chimeric polypeptide of embodiment 97 or 98, wherein the VHH comprises the following framework regions (FRs):
a VHH FR1 with an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS (SEQ ID NO:9011);
a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012);
a VHH FR3 with an amino acid sequence that has at least 85%, 90%, 91%, 92%, 93%, 94%, 95%, 96%, 97%, 98%, or 99% identity, or 100% identity, to RFTISRDNSKNTLYLQMNSLRAEDTAVYYC (SEQ ID NO:9013); and
a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

100. The chimeric polypeptide of any one of embodiments 97-99, wherein the second antigen binding domain comprises the following FRs:
a VL domain FR1 with an amino acid sequence that has at least 85%, 90%, 91%, 92%, 93%, 94%, 95%, 96%, 97%, 98%, or 99% identity, or 100% identity, to

```
                                        (SEQ ID NO: 51)
ELVVTQEPSLTVSPGGTVTLTC;
``` a VL domain FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52);
a VL domain FR3 with an amino acid sequence that has at least 85%, 90%, 91%, 92%, 93%, 94%, 95%, 96%, 97%, 98%, or 99% identity, or 100% identity, to

GTPARFSGSLLGGKAALTLSGVQPEDEAVYYC; (SEQ ID NO: 53)

a VL domain FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59);

a VH domain FR1 with an amino acid sequence that has at least 85%, 90%, 91%, 92%, 93%, 94%, 95%, 96%, 97%, 98%, or 99% identity, or 100% identity, to

EVQLVESGGGIVQPGGSLRLSCAAS; (SEQ ID NO: 400)

a VH domain FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401);

a VH domain FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and a VH domain FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

101. The chimeric polypeptide of any one of embodiments 1-100, wherein
(i) the first antigen binding domain is a VHH comprising the following CDRs:
a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003);
a VHH CDR2 with an amino acid sequence that that has at least 85%, 90%, 91%, 92%, 93%, 94%, 95%, 96%, 97%, 98%, or 99% identity, or 100% identity, to AMSWSGSNRK (SEQ ID NO:9015); and
a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005), and
(ii) and wherein the second antigen binding domain comprises the following CDRs:
a VL domain CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:9006), wherein X$_1$ corresponds to T or N, and X$_2$ corresponds to T or S;
a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4);
a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:9007), wherein X$_4$ corresponds to S or P;
a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:9008), wherein X$_8$ corresponds to S or N;

a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NNYATYYADSVKX$_{12}$ (SEQ ID NO:9009), wherein X$_{10}$ corresponds to T or S, X$_{11}$ corresponds to R or Y, and X$_{12}$ corresponds to G or D;
a VH domain CDR3 with an amino acid sequence that has at least 85%, 90%, 91%, 92%, 93%, 94%, 95%, 96%, 97%, 98%, or 99% identity, or 100% identity, to HX$_{15}$NFGNSYVSWFAX$_{16}$ (SEQ ID NO:9010), wherein X$_{15}$ corresponds to E or G, and X$_{16}$ corresponds to H or Y.

102. The chimeric polypeptide of any one of embodiments 1-101, wherein
(i) the first antigen binding domain is a VHH comprising the following CDRs:
a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003);
a VHH CDR2 with an amino acid sequence that that has at least 85%, 90%, 91%, 92%, 93%, 94%, 95%, 96%, 97%, 98%, or 99% identity, or 100% identity, to AMSWSGSNRK (SEQ ID NO:9015); and
a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005), and
(ii) and wherein the second antigen binding domain comprises the following CDRs:
a VL domain CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1);
a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4);
a VL domain CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6);
a VH domain CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12);
a VH domain CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and
a VH domain CDR3 with an amino acid sequence that has at least 85%, 90%, 91%, 92%, 93%, 94%, 95%, 96%, 97%, 98%, or 99% identity, or 100% identity, to

HENFGNSYVSWFAH. (SEQ ID NO: 10)

103. The chimeric polypeptide of embodiment 101 or 102, wherein the VHH comprises the following framework regions (FRs):

a VHH FR1 with an amino acid sequence that has at least 85%, 90%, 91%, 92%, 93%, 94%, 95%, 96%, 97%, 98%, or 99% identity, or 100% identity, to (SEQ ID NO: 9011)
QVQLVESGGGVVQPGRSLRLSCAAS;

a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012);

a VHH FR3 with an amino acid sequence that has at least 85%, 90%, 91%, 92%, 93%, 94%, 95%, 96%, 97%, 98%, or 99% identity, or 100% identity, to VSDSVKGRFTISRDNSKNTLYLQMNSLRAEDTAVYYC (SEQ ID NO:9016); and a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

104. The chimeric polypeptide of embodiment 101 or 102, wherein the second antigen binding domain comprises the following FRs:

a VL domain FR1 with an amino acid sequence that has at least 85%, 90%, 91%, 92%, 93%, 94%, 95%, 96%, 97%, 98%, or 99% identity, or 100% identity, to (SEQ ID NO: 51)
ELVVTQEPSLTVSPGGTVTLTC;

a VL domain FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52);

a VL domain FR3 with an amino acid sequence that has at least 85%, 90%, 91%, 92%, 93%, 94%, 95%, 96%, 97%, 98%, or 99% identity, or 100% identity, to (SEQ ID NO: 53)
GTPARFSGSLLGGKAALTLSGVQPEDEAVYYC;

a VL domain FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59);

a VH domain FR1 with an amino acid sequence that has at least 85%, 90%, 91%, 92%, 93%, 94%, 95%, 96%, 97%, 98%, or 99% identity, or 100% identity, to (SEQ ID NO: 400)
EVQLVESGGGIVQPGGSLRLSCAAS;

a VH domain FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401);

a VH domain FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and a VH domain FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

105. The chimeric polypeptide of any one of embodiments 1-91, wherein the second antigen binding domain comprises a VL domain comprising an amino acid sequence that has at least 85%, 90%, 91%, 92%, 93%, 94%, 95%, 96%, 97%, 98%, or 99% identity, or 100% identity, to:

(SEQ ID NO: 9001)
ELVVTQEPSLTVSPGGTVTLTCRSSX$_1$GAVTX$_2$SNYANWVQQKPGQAPRG

LIGGTNKRAPGTPARFSGSLLGGKAALTLSGVQPEDEAX$_3$YYCALWYX$_4$N

LWVFGGGTKLTVL, wherein $X_1$ corresponds to T or N, $X_2$ corresponds to T or S, $X_3$ corresponds to E or V, and $X_4$ corresponds to S or P.

106. The chimeric polypeptide of any one of embodiments 1-91, wherein the second antigen binding domain comprises a VL domain comprising an amino acid sequence that has at least 85%, 90%, 91%, 92%, 93%, 94%, 95%, 96%, 97%, 98%, or 99% identity, or 100% identity, to:

(SEQ ID NO: 361)
ELVVTQEPSLTVSPGGTVTLTCRSSNGAVTSSNYANWVQQKPGQAPRGLI

GGTNKRAPGTPARFSGSLLGGKAALTLSGVQPEDEAVYYCALWYPNLWVF

GGGTKLTVL.

107. The chimeric polypeptide of any one of embodiments 1-91, wherein the second antigen binding domain comprises a VH domain comprising an amino acid sequence that has at least 85%, 90%, 91%, 92%, 93%, 94%, 95%, 96%, 97%, 98%, or 99% identity, or 100% identity, to: EVQLX$_5$ESGGGX$_6$VQPGGSLX$_7$LSCAASGF-TFX$_8$TYAMNWVRQAPGKGLEWVX$_9$RIRX$_{10}$K-X$_{11}$NN YATYYADSVKX$_{12}$RFTI-SRDDSKNTX$_{13}$YLQMNX$_{14}$LKTEDTAVYYCV-RHX$_{15}$NFGNSYVSWFAX$_{16}$WGQGTLVTVSS (SEQ ID NO:9002), wherein $X_5$ corresponds to V or L, $X_6$ corresponds to I or L, $X_7$ corresponds to R or K, $X_8$ corresponds to S or N, $X_9$ corresponds to G or A, $X_{10}$ corresponds to T or S, $X_{11}$ corresponds to R or Y, $X_{12}$ corresponds to G or D, $X_{13}$ corresponds to V or A, $X_{14}$ corresponds to S or N, $X_{15}$ corresponds to E or G, and $X_{16}$ corresponds to H or Y.

108. The chimeric polypeptide of any one of embodiments 1-91, wherein the second antigen binding domain comprises a VH domain comprising an amino acid sequence that has at least 85%, 90%, 91%, 92%, 93%, 94%, 95%, 96%, 97%, 98%, or 99% identity, or 100% identity, to:

(SEQ ID NO: 311)
EVQLVESGGGIVQPGGSLRLSCAASGFTFSTYAMNWVRQAPGKGLEWVGR

IRTKRNNYATYYADSVKGRFTISRDDSKNTVYLQMNSLKTEDTAVYYCVR

HENFGNSYVSWFAHWGQGTLVTVSS.

109. The chimeric polypeptide of any one of embodiments 83-108, wherein the VL domain is N-terminal to the VH domain.

110. The chimeric polypeptide of any one of embodiments 83-108, wherein the VL domain is C-terminal to the VH domain.

111. The chimeric polypeptide of any one of embodiments 1-91, wherein the second antigen binding domain comprises a scFV comprising an amino acid sequence that has at least 85%, 90%, 91%, 92%, 93%, 94%, 95%, 96%, 97%, 98%, or 99% identity, or 100% identity, to:

(SEQ ID NO: 215)
ELVVTQEPSLTVSPGGTVTLTCRSSNGAVTSSNYANWVQQKPGQAPRGLI
GGTNKRAPGTPARFSGSLLGGKAALTLSGVQPEDEAVYYCALWYPNLWVF
GGGTKLTVLSESATPESGPGTSPGATPESGPGTSESATPEVQLVESGGGI
VQPGGSLRLSCAASGFTFSTYAMNWVRQAPGKGLEWVGRIRTKRNNYATY
YADSVKGRFTISRDDSKNTVYLQMNSLKTEDTAVYYCVRHENFGNSYVSW
FAHWGQGTLVTVSS.

112. The chimeric polypeptide of any one of embodiments 1-91, wherein the first antigen binding domain comprises a VHH comprising an amino acid sequence that has at least 85%, 90%, 91%, 92%, 93%, 94%, 95%, 96%, 97%, 98%, or 99% identity, or 100% identity, to the amino acid sequence of PSMA.2, PSMA.3, PSMA.5, PSMA.6, PSMA.262, or PSMA.263.

113. The chimeric polypeptide of any one of embodiments 1-91, wherein the first antigen binding domain comprises a VHH comprising an amino acid sequence that has at least 85%, 90%, 91%, 92%, 93%, 94%, 95%, 96%, 97%, 98%, or 99% identity, or 100% identity, to: QVQLVESGGGVVQPGRSLRLSCAASGRTF-GIYVX$_{17}$GWFRQAPGKEREFVGAX$_{18}$SWSGSNRK VSDSVKGRFTISRDNSKNTLYLQMNSLRAE-DTAVYX$_{19}$CX$_{20}$X$_{21}$SNKX$_{22}$YGRTWYDFNESDYWG QGTQVTVSS (SEQ ID NO:9017), wherein X$_{17}$, X$_{18}$, X$_{19}$, X$_{20}$, X$_{21}$, and X$_6$ each, individually, correspond to any naturally occurring amino acid.

114. The chimeric polypeptide of embodiment 113, wherein X$_{17}$ corresponds to M or W, X$_{18}$ corresponds to M or I, X$_{19}$ corresponds to F or Y, X$_{20}$ corresponds to A or G, X$_{21}$ corresponds to A or G, and/or X$_{22}$ corresponds to L, W, R, D, E, or G.

115. The chimeric polypeptide of any one of embodiments 1-91, wherein the first antigen binding domain comprises a VHH comprising an amino acid sequence that has at least 85%, 90%, 91%, 92%, 93%, 94%, 95%, 96%, 97%, 98%, or 99% identity, or 100% identity, to:

(SEQ ID NO: 549)
QVQLVESGGGVVQPGRSLRLSCAASGRTFGIYVWGWFRQAPGKEREFVGA
MSWSGSNRKVSDSVKGRFTISRDNSKNTLYLQMNSLRAEDTAVYYCAASN
KEYGRTWYDFNESDYWGQGTQVTVSS.

116. The chimeric polypeptide of any one of embodiments 1-115, wherein the RS comprises a protease cleavage site is cleavable by at least one protease listed in Table 7.

117. The chimeric polypeptide of any one of embodiments 1-115, wherein the RS comprises an amino acid sequence having at least 85%, 90%, 91%, 92%, 93%, 94%, 95%, 96%, 97%, 98%, or 99% identity, or 100% identity, to a sequence listed in Table 8a.

118. The chimeric polypeptide of any one of embodiments 1-117, wherein the RS is cleavable by uPA, ST14, MMP2, MMP7, MMP9, and MMP14.

119. The chimeric polypeptide of any one of embodiments 1-118, wherein the RS is not cleavable by legumain.

120. The chimeric polypeptide of embodiment 119, wherein the RS is not cleavable by legumain in human blood, plasma, or serum.

121. The chimeric polypeptide of embodiment 119 or 120, wherein the RS is not cleavable upon incubation with about 1 nM or less legumain for about 20 hours.

122. The chimeric polypeptide of any one of embodiments 119-121, wherein the RS is not cleavable upon incubation with about 1 nM or less legumain for about 20 hours in human blood, plasma, or serum.

123. The chimeric polypeptide of embodiment 118, wherein legumain cleaves the RS in human plasma at a rate that is less than about 50% of the rate that RSR-2295 (EAGRSANHTPAGLTGP) (SEQ ID NO:7048) is cleaved by legumain.

124. The chimeric polypeptide of embodiment 118, wherein legumain cleaves the RS in human plasma at a rate that is less than about 25% of the rate that RSR-2295 (EAGRSANHTPAGLTGP) (SEQ ID NO:7048) is cleaved by legumain.

125. The chimeric polypeptide of embodiment 118, wherein legumain cleaves the RS in human plasma at a rate that is less than about 10% of the rate that RSR-2295 (EAGRSANHTPAGLTGP) (SEQ ID NO:7048) is cleaved by legumain.

126. The chimeric polypeptide of embodiment 118, wherein legumain cleaves the RS in human plasma at a rate that is less than about 5% of the rate that RSR-2295 (EAGRSANHTPAGLTGP) (SEQ ID NO:7048) is cleaved by legumain.

127. The chimeric polypeptide of embodiment 118, wherein legumain cleaves the RS in human plasma at a rate that is less than about 2.5% of the rate that RSR-2295 (EAGRSANHTPAGLTGP) (SEQ ID NO:7048) is cleaved by legumain.

128. The chimeric polypeptide of any one of embodiments 17-115, wherein the RS1 and/or RS2 comprises protease cleavage is cleavable by at least one protease listed in Table 7.

129. The chimeric polypeptide of any one of embodiments 17-115, wherein the RS1 and/or RS2 comprises an amino acid sequence having at least 85%, 90%, 91%, 92%, 93%, 94%, 95%, 96%, 97%, 98%, or 99% identity, or 100% identity, to a sequence listed in Table 8a.

130. The chimeric polypeptide of any one of embodiments 17-115, wherein the RS1 and/or RS2 is cleavable by uPA, ST14, MMP2, MMP7, MMP9, and MMP14.

131. The chimeric polypeptide of any one of embodiments 17-115, wherein the RS1 and/or RS2 is not cleavable by legumain.

132. The chimeric polypeptide of embodiment 131, wherein the RS1 and/or RS2 is not cleavable by legumain in human blood, plasma, or serum.

133. The chimeric polypeptide of embodiment 131 or 132, wherein the RS1 and/or RS2 is not cleavable upon incubation with about 1 nM or less legumain for about 20 hours.

134. The chimeric polypeptide of embodiment 131 or 132, wherein the RS1 and/or RS2 is not cleavable upon incubation with about 1 nM or less legumain for about 20 hours in human blood, plasma, or serum.

135. The chimeric polypeptide of embodiment 130, wherein legumain cleaves the RS1 and/or RS2 in human plasma at a rate that is less than about 50% of the rate that RSR-2295 (EAGRSANHTPAGLTGP) (SEQ ID NO:7048) is cleaved by legumain.

136. The chimeric polypeptide of embodiment 130, wherein legumain cleaves the RS1 and/or RS2 in human plasma at a rate that is less than about 25% of the rate that RSR-2295 (EAGRSANHTPAGLTGP) (SEQ ID NO:7048) is cleaved by legumain.

137. The chimeric polypeptide of embodiment 130, wherein legumain cleaves the RS1 and/or RS2 in human plasma at a rate that is less than about 10% of the rate that RSR-2295 (EAGRSANHTPAGLTGP) (SEQ ID NO:7048) is cleaved by legumain.

138. The chimeric polypeptide of embodiment 130, wherein legumain cleaves the RS1 and/or RS2 in human plasma at a rate that is less than about 5% of the rate that RSR-2295 (EAGRSANHTPAGLTGP) (SEQ ID NO:7048) is cleaved by legumain.

139. The chimeric polypeptide of embodiment 130, wherein legumain cleaves the RS1 and/or RS2 in human plasma at a rate that is less than about 2.5% of the rate that RSR-2295 (EAGRSANHTPAGLTGP) (SEQ ID NO:7048) is cleaved by legumain.

140. The chimeric polypeptide of any one of embodiments 17-139, wherein the RS1 comprises a protease-cleavable amino acid sequence comprising the sequence: EAGRSAXHTPAGLTGP (SEQ ID NO: 7627), wherein X is any amino acid other than N.

141. The chimeric polypeptide of any one of embodiments 17-140, wherein the RS2 comprises a protease-cleavable amino acid sequence comprising the sequence: EAGRSAXHTPAGLTGP (SEQ ID NO: 7627), wherein X is any amino acid other than N.

142. The chimeric polypeptide of any one of embodiments 17-141, wherein RS1 and/or RS2 comprises a protease-cleavable amino acid sequence comprising the sequence: EAGRSASHTPAGLTGP (SEQ ID NO: 7628).

143. The chimeric polypeptide of any one of embodiments 17-142, wherein the RS1 and the RS2 are the same.

144. The chimeric polypeptide of any one of embodiments 17-142, wherein the RS1 and the RS2 are different.

145. The chimeric polypeptide of any one of embodiments 1-144, wherein the mask polypeptide is a first mask polypeptide and the protease-cleavable release segment is a first protease-cleavable release segment (RS1), and wherein the chimeric polypeptide further comprises a second mask polypeptide and a second protease-cleavable release segment (RS2), wherein the second mask polypeptide is joined to the second antigen binding domain via a second protease-cleavable release segment (RS2) positioned between the second mask polypeptide and the second antigen binding domain such that the second mask polypeptide reduces the binding of the first antigen binding domain to CD3, wherein the RS2 is cleavable by at least one protease that is present in a tumor.

146. The chimeric polypeptide of any one of embodiments 1-145, wherein the first mask polypeptide is attached to the first antigen binding domain and wherein the second mask polypeptide is attached to the second antigen binding domain.

147. The chimeric polypeptide of any one of embodiments 1-146, wherein the first mask polypeptide is a first ELNN and the second mask polypeptide is a second ELNN.

148. The chimeric polypeptide of any one of embodiments 1-147, wherein the first ELNN and the second ELNN are each individually characterized in that:
(i) at least 90% of each of the first ELNN's and the second ELNN's amino acids are glycine (G), alanine (A), serine (S), threonine (T), glutamate (E), proline (P), or any combination thereof; and
(ii) each comprises at least 3 types of amino acids selected from the group consisting of G, A, S, T, E, and P.

149. The chimeric polypeptide of embodiment 148, wherein the first ELNN and the second ELNN are each individually further characterized in that:
(i) each comprises at least 100 amino acid residues;
(ii) each comprises a plurality of non-overlapping sequence motifs that are each from 9 to 14 amino acids in length, wherein the plurality of non-overlapping sequence motifs comprise a set of non-overlapping sequence motives, wherein each non-overlapping sequence motive of the set of non-overlapping sequence motifs is repeated at least two times in the ELNN.

150. The chimeric polypeptide of embodiment 149, wherein the plurality of non-overlapping sequence motifs comprises at least one non-overlapping sequence motif that occurs only once within the ELNN.

151. The chimeric polypeptide of embodiment 149 or 150, wherein the non-overlapping sequence motifs comprise one of or any combination of the sequence motifs listed in Table 1.

152. The chimeric polypeptide of embodiment 149 or 150, wherein the non-overlapping sequence motifs comprise at least 2, 3, or 4 of the sequence motifs listed in Table 1.

153. The chimeric polypeptide of embodiment 149 or 150, wherein the non-overlapping sequence motifs comprise any one of or any combination of GTSTEPSEGSAP (SEQ ID NO:189), GTSESATPESGP (SEQ ID NO:188), GSGPGTSESATP (SEQ ID NO:9018), GSEPATSGSETP (SEQ ID NO:187), GSPAGSPTSTEE (SEQ ID NO:186), and GTSPSATPESGP (SEQ ID NO:9019).

154. The chimeric polypeptide of any one of embodiments 147-153, wherein each of the first ELNN and the second ELNN comprises at least 4 types of amino acids selected from the group consisting of G, A, S, T, E, and P.

155. The chimeric polypeptide of any one of embodiments 147-154, wherein the amino acids of each of the first ELNN and the second ELNN consists of A, E, G, S, P, and/or T.

156. The chimeric polypeptide of any one of embodiments 147-155, wherein the amino acid sequence of the first ELNN is at least 100 amino acids shorter than the amino acid sequence of the second ELNN.

157. The chimeric polypeptide of any one of embodiments 147-155, wherein the amino acid sequence of the first ELNN is at least 200 amino acids shorter than the amino acid sequence of the second ELNN.

158. The chimeric polypeptide of any one of embodiments 147-155, wherein the amino acid sequence of the first ELNN is at least 250 amino acids shorter than the amino acid sequence of the second ELNN.

159. The chimeric polypeptide of any one of embodiments 1-(7-155, wherein the amino acid sequence of the first ELNN is about 294 amino acids in length, and wherein the amino acid sequence of the second ELNN is about 582 amino acids in length.

160. The chimeric polypeptide of any one of embodiments 147-159, wherein the first ELNN and/or the second ELNN comprises an amino acid sequence that is at least 85% identical to an amino acid sequence listed in Table 3a or 3b.

161. The chimeric polypeptide of any one of embodiments 147-160, wherein the first ELNN comprises an amino acid sequence that has at least 85%, 90%, 91%, 92%, 93%, 94%, 95%, 96%, 97%, 98%, or 99% identity, or 100% identity, to:

(SEQ ID NO: 8021)
ASSATPESGPGTSTEPSEGSAPGTSESATPESGPGSGPGTSESATPGTSE
SATPESGPGSEPATSGSETPGTSESATPESGPGTSTEPSEGSAPGSPAGS
PTSTEEGTSESATPESGPGSEPATSGSETPGTSESATPESGPGSPAGSPT
STEEGSPAGSPTSTEEGTSTEPSEGSAPGTSESATPESGPGTSESATPES
GPGTSESATPESGPGSEPATSGSETPGSEPATSGSETPGSPAGSPTSTEE
GTSTEPSEGSAPGTSTEPSEGSAPGSEPATSGSETPGTSESATP.

162. The chimeric polypeptide of any one of embodiments 147-161, wherein the second ELNN comprises an amino acid sequence that has at least 85%, 90%, 91%, 92%, 93%, 94%, 95%, 96%, 97%, 98%, or 99% identity, or 100% identity, to:

(SEQ ID NO: 8022)
ATPESGPGTSESATPESGPGSPAGSPTSTEEGTSESATPESGPGSEPATS
GSETPGTSESATPESGPGTSTEPSEGSAPGTSTEPSEGSAPGTSTEPSEG
SAPGTSTEPSEGSAPGTSTEPSEGSAPGTSTEPSEGSAPGSPAGSPTSTE
EGTSTEPSEGSAPGTSESATPESGPGSEPATSGSETPGTSESATPESGPG
SEPATSGSETPGTSESATPESGPGTSTEPSEGSAPGTSESATPESGPGSP
AGSPTSTEEGSPAGSPTSTEEGSPAGSPTSTEEGTSESATPESGPGTSTE
PSEGSAPGTSESATPESGPGSEPATSGSETPGTSESATPESGPGSEPATS
GSETPGTSESATPESGPGTSTEPSEGSAPGSPAGSPTSTEEGTSESATPE
SGPGSEPATSGSETPGTSESATPESGPGSPAGSPTSTEEGSPAGSPTSTE
EGTSTEPSEGSAPGTSESATPESGPGTSESATPESGPGTSPSATPESGPG
SEPATSGSETPGSEPATSGSETPGSPAGSPTSTEEGTSTEPSEGSAPGTS
TEPSEGSAPGSEPATSGSETPGTSESAGEPEA.

163. The chimeric polypeptide of any one of embodiments 1-162, comprising one or more barcode fragments.
164. The chimeric polypeptide of any one of embodiments 1-163, comprising two or more barcode fragments.
165. The chimeric polypeptide of embodiment 163 or 164, wherein each barcode fragment is different from every other barcode fragment.
166. The chimeric polypeptide of any one of embodiments 163-165, wherein each barcode fragment differs in both sequence and molecular weight from all other peptide fragments that are releasable from the chimeric polypeptide upon complete digestion the chimeric polypeptide by a non-mammalian protease.
167. The chimeric polypeptide of embodiment 166, wherein the non-mammalian protease is Glu-C.
168. The chimeric polypeptide of any one of embodiments 1-167, comprising a Glu-C cleavage site comprising one of the following amino acid sequences: ATPESGPG (SEQ ID NO:9020), SGSETPGT (SEQ ID NO:9021), and GTSESATP (SEQ ID NO:9022).

169. The chimeric polypeptide of any one of embodiments 1-168, comprising at least one of the following amino acid sequences: SGPE.SGPGX$_n$SGPE.SGPG (SEQ ID NO:9023), SGPE.SGPGX$_n$ATPE.SGPG (SEQ ID NO:9024), SGPE.SGPGX$_n$GTSE.SATP (SEQ ID NO:9025), SGPE.SGPGX$_n$TTPE.SGPG (SEQ ID NO:9026), SGPE.SGPGX$_n$STPE.SGPG (SEQ ID NO:9027), SGPE.SGPGX$_n$GTPE.SGPG (SEQ ID NO:9028), SGPE.SGPGX$_n$GTPE.TPGS (SEQ ID NO:9029), SGPE.SGPGX$_n$GTPE.TPGS (SEQ ID NO:9029), SGPE.SGPGX$_n$SGSE.TGTP (SEQ ID NO:9030), SGPE.SGPGX$_n$GTPE.GSAP (SEQ ID NO:9031), SGPE.SGPGX$_n$EPSE.SATP (SEQ ID NO:9032), ATPE.SGPGX$_n$SGPE.SGPG (SEQ ID NO:9033), ATPE.SGPGX$_n$ATPE.SGPG (SEQ ID NO:9034), ATPE.SGPGX$_n$GTSE.SATP (SEQ ID NO:9035), ATPE.SGPGX$_n$TTPE.SGPG (SEQ ID NO:9036), ATPE.SGPGX$_n$STPE.SGPG (SEQ ID NO:9037), ATPE.SGPGX$_n$GTPE.SGPG (SEQ ID NO:9043), ATPE.SGPGX$_n$GTPE.TPGS (SEQ ID NO:9045), ATPE.SGPGX$_n$SGSE.TGTP (SEQ ID NO:9046), ATPE.SGPGX$_n$GTPE.GSAP (SEQ ID NO:9047), ATPE.SGPGX$_n$EPSE.SATP (SEQ ID NO:9048), GTSE.SATPX$_n$SGPE.SGPG (SEQ ID NO:9049), GTSE.SATPX$_n$ATPE.SGPG (SEQ ID NO:9050), GTSE.SATPX$_n$GTSE.SATP (SEQ ID NO:9051), GTSE.SATPX$_n$TTPE.SGPG (SEQ ID NO:9052), GTSE.SATPX$_n$STPE.SGPG (SEQ ID NO:9053), GTSE.SATPX$_n$GTPE.SGPG (SEQ ID NO:9054), GTSE.SATPX$_n$GTPE.TPGS (SEQ ID NO:9055), GTSE.SATPX$_n$SGSE.TGTP (SEQ ID NO:9056), GTSE.SATPX$_n$GTPE.GSAP (SEQ ID NO:9057), GTSE.SATPX$_n$EPSE.SATP (SEQ ID NO:9058), TTPE.SGPGX$_n$SGPE.SGPG (SEQ ID NO:9059), TTPE.SGPGX$_n$ATPE.SGPG (SEQ ID NO:9060), TTPE.SGPGX$_n$GTSE.SATP (SEQ ID NO:9061), TTPE.SGPGX$_n$TTPE.SGPG (SEQ ID NO:9062), TTPE.SGPGX$_n$STPE.SGPG (SEQ ID NO:9064), TTPE.SGPGX$_n$GTPE.SGPG (SEQ ID NO:9065), TTPE.SGPGX$_n$GTPE.TPGS (SEQ ID NO:9066), TTPE.SGPGX$_n$SGSE.TGTP (SEQ ID NO:9067), TTPE.SGPGX$_n$GTPE.GSAP (SEQ ID NO:9068), TTPE.SGPGX$_n$EPSE.SATP (SEQ ID NO:9069), STPE.SGPGX$_n$SGPE.SGPG (SEQ ID NO:9070), STPE.SGPGX$_n$ATPE.SGPG (SEQ ID NO:9071), STPE.SGPGX$_n$GTSE.SATP (SEQ ID NO:9072), STPE.SGPGX$_n$TTPE.SGPG (SEQ ID NO:9073), STPE.SGPGX$_n$STPE.SGPG (SEQ ID NO:9074), STPE.SGPGX$_n$GTPE.SGPG (SEQ ID NO:9076), STPE.SGPGX$_n$GTPE.TPGS (SEQ ID NO:9077), STPE.SGPGX$_n$SGSE.TGTP (SEQ ID NO:9078), STPE.SGPGX$_n$GTPE.GSAP (SEQ ID NO:9079), STPE.SGPGX$_n$EPSE.SATP (SEQ ID NO:9080), GTPE.SGPGX$_n$SGPE.SGPG (SEQ ID NO:9081), GTPE.SGPGX$_n$ATPE.SGPG (SEQ ID NO:9082), GTPE.SGPGX$_n$GTSE.SATP (SEQ ID NO:9083), GTPE.SGPGX$_n$TTPE.SGPG (SEQ ID NO:9084), GTPE.SGPGX$_n$STPE.SGPG (SEQ ID NO:9086), GTPE.SGPGX$_n$GTPE.SGPG (SEQ ID NO:9088), GTPE.SGPGX$_n$GTPE.TPGS (SEQ ID NO:9090), GTPE.SGPGX$_n$SGSE.TGTP (SEQ ID NO:9091), GTPE.SGPGX$_n$GTPE.GSAP (SEQ ID NO:9092), GTPE.SGPGX$_n$EPSE.SATP (SEQ ID NO:9093), GTPE.TPGSX$_n$SGPE.SGPG (SEQ ID NO:9094), GTPE.TPGSX$_n$ATPE.SGPG (SEQ ID NO:9095), GTPE.TPGSX$_n$GTSE.SATP (SEQ ID NO:9096), GTPE.TPGSX$_n$TTPE.SGPG (SEQ ID NO:9097), GTPE.TPGSX$_n$STPE.SGPG (SEQ ID NO:9098), GTPE.TPGSX$_n$GTPE.SGPG (SEQ ID NO:9099), GTPE.TPGSX$_n$GTPE.TPGS (SEQ ID NO:9100), GTPE.TPGSX$_n$SGSE.TGTP (SEQ ID NO:9101), GTPE.TPGSX$_n$GTPE.GSAP (SEQ ID NO:9103), GTPE.TPGSX$_n$EPSE.SATP (SEQ ID NO:9104), SGSE.TGTPX$_n$SGPE.SGPG (SEQ ID NO:9105), SGSE.TGTPX$_n$ATPE.SGPG (SEQ ID NO:9106), SGSE.TGTPX$_n$GTSE.SATP (SEQ ID NO:9107), SGSE.TGTPX$_n$TTPE.SGPG (SEQ ID NO:9108), SGSE.TGTPX$_n$STPE.SGPG (SEQ ID NO:9109), SGSE.TGTPX$_n$GTPE.SGPG (SEQ ID NO:9110), SGSE.TGTPX$_n$GTPE.TPGS (SEQ ID NO:9111), SGSE.TGTPX$_n$SGSE.TGTP (SEQ ID NO:9112), SGSE.TGTPX$_n$GTPE.GSAP (SEQ ID NO:9113), SGSE.TGTPX$_n$EPSE.SATP (SEQ ID NO:9114), GTPE.GSAPX$_n$SGPE.SGPG (SEQ ID NO:9115), GTPE.GSAPX$_n$ATPE.SGPG (SEQ ID NO:9116), GTPE.GSAPX$_n$GTSE.SATP (SEQ ID NO:9117), GTPE.GSAPX$_n$TTPE.SGPG (SEQ ID NO:9118), GTPE.GSAPX$_n$STPE.SGPG (SEQ ID NO:9119), GTPE.GSAPX$_n$GTPE.SGPG (SEQ ID NO:9120), GTPE.GSAPX$_n$GTPE.TPGS (SEQ ID NO:9121), GTPE.GSAPX$_n$SGSE.TGTP (SEQ ID NO:9122), GTPE.GSAPX$_n$GTPE.GSAP (SEQ ID NO:9123), GTPE.GSAPX$_n$EPSE.SATP (SEQ ID NO:9124), EPSE.SATPX$_n$SGPE.SGPG (SEQ ID NO:9126), EPSE.SATPX$_n$ATPE.SGPG (SEQ ID NO:9127), EPSE.SATPX$_n$GTSE.SATP (SEQ ID NO:9128), EPSE.SATPX$_n$TTPE.SGPG (SEQ ID NO:9129), EPSE.SATPX$_n$STPE.SGPG (SEQ ID NO:9130), EPSE.SATPX$_n$GTPE.SGPG (SEQ ID NO:9131), EPSE.SATPX$_n$GTPE.TPGS (SEQ ID NO:9132), EPSE.SATPX$_n$SGSE.TGTP (SEQ ID NO:9133), EPSE.SATPX$_n$GTPE.GSAP (SEQ ID NO:9134), or EPSE.SATPX$_n$EPSE.SATP (SEQ ID NO:9135), wherein each "." is a Glu-C cleavage site and n is any integer from 0 to 50.

170. The chimeric polypeptide of embodiment 169, comprising at least one of the following amino acid sequences: SGPE.SGPGX$_n$ATPE.SGPG (SEQ ID NO:9038), ATPE.SGPGX$_n$GTSE.SATP (SEQ ID NO:9040), ATPE.SGPGX$_n$TTPE.SGPG (SEQ ID NO:9041), ATPE.SGPGX$_n$STPE.SGPG (SEQ ID NO:9042), ATPE.SGPGX$_n$ATPE.SGPG (SEQ ID NO:9039), ATPE.SGPGX$_n$GTPE.SGPG (SEQ ID NO:9044), ATPE.SGPGX$_n$GTPE.SGPG (SEQ ID NO:9044), ATPE.SGPGX$_n$ATPE.SGPG (SEQ ID NO:9039), GTPE.SGPGX$_n$GTPE.SGPG (SEQ ID NO:9089), GTPE.SGPGX$_n$STPE.SGPG (SEQ ID NO:9087), GTPE.SGPGX$_n$TTPE.SGPG (SEQ ID NO:9085), GTPE.SGPGX$_n$STPE.SGPG (SEQ ID NO:9087), GTPE.TPGSX$_n$SGSE.TGTP (SEQ ID NO:9102), GTPE.GSAPX$_n$EPSE.SATP (SEQ ID NO:9125), ATPE.SGPGX$_n$GTPE.SGPG (SEQ ID NO:9044), ATPE.SGPGX$_n$GTPE.SGPG (SEQ ID NO:9044), ATPE.SGPGX$_n$ATPE.SGPG (SEQ ID NO:9039), ATPE.SGPGX$_n$GTPE.SGPG (SEQ ID NO:9044), TTPE.SGPGX$_n$TTPE.SGPG (SEQ ID NO:9063), or STPE.SGPGX$_n$STPE.SGPG (SEQ ID NO:9075), wherein each "." is a Glu-C cleavage site and n is any integer from 0 to 30.

171. The chimeric polypeptide of any one of embodiments 169 or 170, wherein n is any integer from 1 to 20.

172. The chimeric polypeptide of any one of embodiments 169-171, wherein n is any integer from 5 to 15.

173. The chimeric polypeptide of any one of embodiments 169-172, wherein n is any integer from 3 to 7.

174. The chimeric polypeptide of any one of embodiments 169-172, wherein n is any integer from 5 to 10.

175. The chimeric polypeptide of any one of embodiments 169-172, wherein n is 9.

176. The chimeric polypeptide of any one of embodiments 169-174, wherein n is 4.

177. The chimeric polypeptide of an one of embodiments 169-176, wherein X$_n$ is

PGTGTSAT, (SEQ ID NO: 9136)

PGSGPGT, (SEQ ID NO: 9137)

PGTTPGTT, (SEQ ID NO: 9138)

PGTPPTST, (SEQ ID NO: 9139)

PGTSPSAT, (SEQ ID NO: 9140)

PGTGSAGT, (SEQ ID NO: 9141)

PGTGGAGT, (SEQ ID NO: 9142)

PGTSPGAT, (SEQ ID NO: 9143)

PGTSGSGT, (SEQ ID NO: 9144)

PGTSSAST, (SEQ ID NO: 9145)

PGTGAGTT, (SEQ ID NO: 9146)

PGTGSTST, (SEQ ID NO: 9147)

GSEPATSG, (SEQ ID NO: 9148)

APGTSTEP, (SEQ ID NO: 9149)

PGTAGSGT, (SEQ ID NO: 9150)

PGTSSGGT, (SEQ ID NO: 9151)

PGTAGPAT, (SEQ ID NO: 9152)

PGTPGTGT, (SEQ ID NO: 9153)

PGTGGPTT, (SEQ ID NO: 9154)

or

PGTGSGST. (SEQ ID NO: 9155)

178. The chimeric polypeptide of any one of embodiments 169-177, wherein $X_n$ is TGTS

TGTS, (SEQ ID NO: 9156)

SGP, TTPG, (SEQ ID NO: 9157)

TPPT, (SEQ ID NO: 9158)

TSPS, (SEQ ID NO: 9159)

TGSA, (SEQ ID NO: 9160)

TGGA, (SEQ ID NO: 9161)

TSPG, (SEQ ID NO: 9162)

TSGS, (SEQ ID NO: 9163)

TSSA, (SEQ ID NO: 9164)

TGAG, (SEQ ID NO: 9165)

TGST, (SEQ ID NO: 9166)

EPAT, (SEQ ID NO: 9167)

GTST, (SEQ ID NO: 9168)

TAGS, (SEQ ID NO: 9169)

TSSG, (SEQ ID NO: 9170)

TAGP, (SEQ ID NO: 9171)

TPGT, (SEQ ID NO: 9172)

TGGP, (SEQ ID NO: 9173)
or

TGSG. (SEQ ID NO: 9174)

179. The chimeric polypeptide of any one of embodiments 1-178, wherein neither the N-terminal amino acid nor the C-terminal acid of the chimeric polypeptide is included in a barcode fragment.
180. The chimeric polypeptide of any one of embodiments 1-179, comprising an ELNN with a non-overlapping sequence motif that occurs only once within the ELNN, wherein the ELNN further comprises a barcode fragment that includes at least part of the non-overlapping sequence motif that occurs only once within the ELNN.
181. The chimeric polypeptide of any one of embodiments 1-179, comprising a first ELNN with a first barcode fragment and a second ELNN with a second barcode fragment, wherein neither the first barcode fragment nor the second barcode fragment includes a glutamate that is immediately adjacent to another glutamate, if present, in the ELNN that contains the barcode fragment.
182. The chimeric polypeptide of embodiment 181, wherein at least one of the barcode fragments comprises a glutamate at the C-terminus thereof.
183. The chimeric polypeptide of embodiments 181 or 182, wherein at least one of the barcode fragments has an N-terminal amino acid that is immediately preceded by a glutamate in the chimeric polypeptide.
184. The chimeric polypeptide of embodiment 181, wherein the glutamate that precedes the N-terminal amino acid of the barcode fragment is not immediately adjacent to another glutamate.
185. The chimeric polypeptide of any one of embodiments 181-184, wherein at least one of the barcode fragments does not include a second glutamate at a position other than the C-terminus of the barcode fragment unless the second glutamate is immediately followed by a proline.
186. The chimeric polypeptide of any one of embodiments 1-185, comprising a single polypeptide chain, wherein the chimeric polypeptide comprises a barcode fragment that is at a position within the polypeptide chain that is from 10 to 200 amino acids or from 10 to 125 amino acids from the N-terminus or the C-terminus of the chimeric polypeptide.
187. The chimeric polypeptide of any one of embodiments 181-186, wherein the first ELNN is at the N-terminal side of the bispecific antibody domain, and wherein the first barcode fragment is positioned within 200, 150, 100, or 50 amino acids of the N-terminus of the chimeric polypeptide.
188. The chimeric polypeptide of any one of embodiments 181-187, wherein the second ELNN is at the C-terminal side of the bispecific antibody domain, and wherein the second barcode fragment is positioned within 200, 150, 100, or 50 amino acids of the C-terminus of the chimeric polypeptide.
189. The chimeric polypeptide of any one of embodiments 163-188, wherein at least one of the barcode fragments is at least 4 amino acids in length.
190. The chimeric polypeptide of any one of embodiments 163-189, wherein at least one of the barcode fragments is from 4 to 20, from 5 to 15, from 6 to 12, or from 7 to 10 amino acids in length.
191. The chimeric polypeptide of embodiment 190, wherein each mask polypeptide comprises one barcode fragment that is listed in Table 2 or disclosed in Table 3a.
192. The chimeric polypeptide of any one of embodiments 1-191, comprising a barcode fragment comprising an amino acid sequence that has at least 85%, 90%, 91%, 92%, 93%, 94%, 95%, 96%, 97%, 98%, or 99% identity, or 100% identity, to SGPGSGPGTSE (SEQ ID NO:78) or SGPGTSPSATPE (SEQ ID NO:79).
193. The chimeric polypeptide of any one of embodiments 1-192, comprising one barcode fragment comprising an amino acid sequence that is at least 95% identical to SGPGSGPGTSE (SEQ ID NO:78) and one barcode fragment comprising an amino acid sequence that is at least 95% identical to SGPGTSPSATPE (SEQ ID NO:79).
194. The chimeric polypeptide of any one of embodiments 163-193, wherein the barcode fragment consists of A, E, G, S, P, and/or T residues.

195. The chimeric polypeptide of any one of embodiments 163-194, wherein the barcode fragment is part of a mask peptide.
196. The chimeric polypeptide of embodiment 195, wherein the mask peptide is the first ELNN or the second ELNN.
197. The chimeric polypeptide of any one of embodiments 1-196, comprising an amino acid sequence that has at least 85%, 90%, 91%, 92%, 93%, 94%, 95%, 96%, 97%, 98%, or 99% identity, or 100% identity, to a sequence listed in Table D (SEQ ID NOs: 1000-1009).
198. The chimeric polypeptide of any one of embodiments 1-197, comprising an amino acid sequence that has at least 85%, 90%, 91%, 92%, 93%, 94%, 95%, 96%, 97%, 98%, or 99% identity, or 100% identity, to:

(SEQ ID NO: 1000)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATPEAGRSA

SHTPAGLTGPGTSESATPESQVQLVESGGGWVQPGRSLRLSCAASGRTFG

IYVWGWFRQAPGKEREFVGAMSWSGSNRKVSDSVKGRFTISRDNSKNTLY

LQMNSLRAEDTAVYYCAASNKEYGRTWYDFNESDYWGQGTQVTVSSGGGG

SGGGSELVVTQEPSLTVSPGGTVTLTCRSSNGAVTSSNYANWVQQKPGQA

PRGLIGGTNKRAPGTPARFSGSLLGGKAALTLSGVQPEDEAVYYCALWYP

NLWVFGGGTKLTVLSESATPESGPGTSPGATPESGPGTSESATPEVQLVE

SGGGIVQPGGSLRLSCAASGFTFSTYAMNWVRQAPGKGLEWVGRIRTKRN

NYATYYADSVKGRFTISRDDSKNTVYLQMNSLKTEDTAVYYCVRHENFGN

SYVSWFAHWGQGTLVTVSSGTATPESGPGEAGRSASHTPAGLTGPATPES

GPGTSESATPESGPGSPAGSPTSTEEGTSESATPESGPGSEPATSGSETP

GTSESATPESGPGTSTEPSEGSAPGTSTEPSEGSAPGTSTEPSEGSAPGT

STEPSEGSAPGTSTEPSEGSAPGTSTEPSEGSAPGSPAGSPTSTEEGTST

EPSEGSAPGTSESATPESGPGSEPATSGSETPGTSESATPESGPGSEPAT

SGSETPGTSESATPESGPGTSTEPSEGSAPGTSESATPESGPGSPAGSPT

STEEGSPAGSPTSTEEGSPAGSPTSTEEGTSESATPESGPGTSTEPSEGS

APGTSESATPESGPGSEPATSGSETPGTSESATPESGPGSEPATSGSETP

GTSESATPESGPGTSTEPSEGSAPGSPAGSPTSTEEGTSESATPESGPGS

EPATSGSETPGTSESATPESGPGSPAGSPTSTEEGSPAGSPTSTEEGTST

EPSEGSAPGTSESATPESGPGTSESATPESGPGTSPSATPESGPGSEPAT

SGSETPGSEPATSGSETPGSPAGSPTSTEEGTSTEPSEGSAPGTSTEPSE

GSAPGSEPATSGSETPGTSESAGEPEA.

199. The chimeric polypeptide of embodiment 198, comprising the following amino acid sequence:

(SEQ ID NO: 1000)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATPEAGRSA

SHTPAGLTGPGTSESATPESQVQLVESGGGWVQPGRSLRLSCAASGRTFG

IYVWGWFRQAPGKEREFVGAMSWSGSNRKVSDSVKGRFTISRDNSKNTLY

LQMNSLRAEDTAVYYCAASNKEYGRTWYDFNESDYWGQGTQVTVSSGGGG

SGGGSELVVTQEPSLTVSPGGTVTLTCRSSNGAVTSSNYANWVQQKPGQA

PRGLIGGTNKRAPGTPARFSGSLLGGKAALTLSGVQPEDEAVYYCALWYP

NLWVFGGGTKLTVLSESATPESGPGTSPGATPESGPGTSESATPEVQLVE

SGGGIVQPGGSLRLSCAASGFTFSTYAMNWVRQAPGKGLEWVGRIRTKRN

NYATYYADSVKGRFTISRDDSKNTVYLQMNSLKTEDTAVYYCVRHENFGN

SYVSWFAHWGQGTLVTVSSGTATPESGPGEAGRSASHTPAGLTGPATPES

GPGTSESATPESGPGSPAGSPTSTEEGTSESATPESGPGSEPATSGSETP

GTSESATPESGPGTSTEPSEGSAPGTSTEPSEGSAPGTSTEPSEGSAPGT

STEPSEGSAPGTSTEPSEGSAPGTSTEPSEGSAPGSPAGSPTSTEEGTST

EPSEGSAPGTSESATPESGPGSEPATSGSETPGTSESATPESGPGSEPAT

SGSETPGTSESATPESGPGTSTEPSEGSAPGTSESATPESGPGSPAGSPT

STEEGSPAGSPTSTEEGSPAGSPTSTEEGTSESATPESGPGTSTEPSEGS

APGTSESATPESGPGSEPATSGSETPGTSESATPESGPGSEPATSGSETP

GTSESATPESGPGTSTEPSEGSAPGSPAGSPTSTEEGTSESATPESGPGS

EPATSGSETPGTSESATPESGPGSPAGSPTSTEEGSPAGSPTSTEEGTST

EPSEGSAPGTSESATPESGPGTSESATPESGPGTSPSATPESGPGSEPAT

SGSETPGSEPATSGSETPGSPAGSPTSTEEGTSTEPSEGSAPGTSTEPSE

GSAPGSEPATSGSETPGTSESAGEPEA.

200. A pharmaceutical composition comprising the chimeric polypeptide of any one of embodiments 1-199 and at least one pharmaceutically acceptable excipient.
201. The pharmaceutical composition of embodiment 200, which is in a liquid form or is frozen.
202. The pharmaceutical composition of embodiment 200, which is formulated as a lyophilized powder or cake to be reconstituted prior to administration.
203. An injection device comprising the pharmaceutical composition of embodiment 200.
204. The injection device of embodiment 203, which comprises a syringe.
205. A polynucleotide sequence encoding the chimeric polypeptide of any one of embodiments 1-204.
206. An expression vector comprising the polynucleotide sequence of embodiment 205.
207. A host cell comprising the expression vector of embodiment 205.
208. A method of producing the chimeric polypeptide of any one of embodiments 1-199.

209. The method of embodiment 208, further comprising isolating the chimeric polypeptide from a host cell.
210. A method of treating cancer in a subject in need thereof, the method comprising administering an effective amount of the chimeric polypeptide of any one of embodiments 1-199 to the subject.
211. The method of embodiment 210, wherein the cancer comprises a solid tumor.
212. The method of embodiment 210 or 211, wherein the cancer is a carcinoma.
213. The method of any one of embodiments 210-212, wherein the cancer is prostate cancer.
214. The method of embodiment 213, wherein the prostate cancer is metastatic prostate cancer.
215. The method of embodiment 213, wherein the prostate cancer is androgen-independent.
216. The method of embodiment 213, wherein the prostate cancer is non-metastatic castration-resistant prostate cancer (nmCRPC).
217. The method of embodiment 213, wherein the prostate cancer is metastatic castration-resistant prostate cancer (mCRPC).
218. The method of any one of embodiments 210-217, further comprising administering docetaxel to the subject.
219. The method of any one of embodiments 210-218, further comprising administering a checkpoint inhibitor to the subject.
220. The method of embodiment 219, wherein the checkpoint inhibitor is a PD-1 inhibitor, a PD-L1 inhibitor, or a CTLA-4 inhibitor.
221. The method of embodiment 219, wherein the checkpoint inhibitor is an anti-PD-1 antibody or an anti-PD-L1 antibody.
222. The method of embodiment 219, wherein the checkpoint inhibitor is pembrolizumab or cemiplimab.
223. A linker polypeptide comprising an amino acid sequence that has at least 85%, 90%, 91%, 92%, 93%, 94%, 95%, 96%, 97%, 98%, or 99% identity, or 100% identity, to (SEQ ID NO: 81)
SESATPESGPGTSPGATPESGPGTSESATP.

224. The linker polypeptide of embodiment 223, which is cleavable by a non-mammalian protease.
225. The linker polypeptide of embodiment 224, wherein the non-mammalian protease is Glu-C.
226. The linker polypeptide of any one of embodiments 223-225, wherein the linker polypeptide connects a first polypeptide moiety to a second polypeptide moiety.
227. The linker polypeptide of any one of embodiments 223-226, wherein the first polypeptide moiety is a VL domain and the second polypeptide moiety is a VH domain.
228. An antigen binding polypeptide comprising a VL domain and a VH domain, wherein the VL domain is linked to the VH domain by a linker polypeptide comprising an amino acid sequence that has at least 85%, 90%, 91%, 92%, 93%, 94%, 95%, 96%, 97%, 98%, or 99% identity, or 100% identity, to SESATPESGPGTSPGATPESGPGTSESATP (SEQ ID NO: 81).
229. The antigen binding polypeptide of embodiment 228, wherein the linker polypeptide is cleavable by a non-mammalian protease.
230. The antigen binding polypeptide of embodiment 229, wherein the non-mammalian protease is Glu-C.
231. The antigen binding polypeptide of any one of embodiments 228-230, which is an scFv.
232. The antigen binding polypeptide of any one of embodiments 228-231, wherein the antigen is CD3.
233. The antigen binding polypeptide of embodiment 232, wherein the antigen is CD3 epsilon.
234. The linker polypeptide of any one of embodiments 223-227 or the antigen binding domain of any one of embodiments 228-233, wherein the VL domain is N-terminal to the VH domain.
235. The linker polypeptide of any one of embodiments 223-227 or the antigen binding domain of any one of embodiments 228-233, wherein the VH domain is N-terminal to the VL domain.
236. A pharmaceutical composition comprising the linker polypeptide of any one of embodiments 223-227 or the antigen binding polypeptide of any one of embodiments 228-233, and at least one pharmaceutically acceptable excipient.
237. The pharmaceutical composition of embodiment 236, which is in a liquid form or is frozen.
238. The pharmaceutical composition of embodiment 236, which is formulated as a lyophilized powder or cake to be reconstituted prior to administration.
239. An injection device comprising the pharmaceutical composition of embodiment 236.
240. The injection device of embodiment 239, which comprises a syringe.
241. A polynucleotide sequence encoding the linker of any one of embodiments 223-227 or the antigen binding polypeptide of any one of embodiments 228-233.
242. An expression vector comprising the polynucleotide sequence of embodiment 241.
243. A host cell comprising the expression vector of embodiment 242.
244. A method of producing the linker of any one of embodiments 223-227 or the antigen binding polypeptide of any one of embodiments 228-233.
245. The method of embodiment 244, further comprising isolating the linker or antigen binding polypeptide from a host cell.
246. An isolated polypeptide comprising a protease-cleavable amino acid sequence comprising the sequence: EAGRSAXHTPAGLTGP (SEQ ID NO: 7627), wherein X is any amino acid other than N.
247. The isolated polypeptide of embodiment 246, wherein X is S.
248. The isolated polypeptide of embodiment 246, which is not cleavable by legumain.
249. The isolated polypeptide of embodiment 246, which is not cleavable by legumain in human blood, plasma, or serum.
250. The isolated polypeptide of embodiment 246, which is not cleavable upon incubation with about 1 nM or less legumain for about 20 hours.
251. The isolated polypeptide of embodiment 246, which is not cleavable upon incubation with about 1 nM or less legumain for about 20 hours in human blood, plasma, or serum.
252. The isolated polypeptide of embodiment 246, wherein legumain cleaves the isolated polypeptide in human plasma at a rate that is less than about 50% of the rate that RSR-2295 (EAGRSANHTPAGLTGP) (SEQ ID NO:7048) is cleaved by legumain.

253. The isolated polypeptide of embodiment 246, wherein legumain cleaves the isolated polypeptide in human plasma at a rate that is less than about 25% of the rate that RSR-2295 (EAGRSANHTPAGLTGP) (SEQ ID NO:7048) is cleaved by legumain.
254. The isolated polypeptide of embodiment 246, wherein legumain cleaves the isolated polypeptide in human plasma at a rate that is less than about 10% of the rate that RSR-2295 (EAGRSANHTPAGLTGP) (SEQ ID NO:7048) is cleaved by legumain.
255. The isolated polypeptide of embodiment 246, wherein legumain cleaves the isolated polypeptide in human plasma at a rate that is less than about 5% of the rate that RSR-2295 (EAGRSANHTPAGLTGP) (SEQ ID NO:7048) is cleaved by legumain.
256. The isolated polypeptide of embodiment 246, wherein legumain cleaves the isolated polypeptide in human plasma at a rate that is less than about 2.5% of the rate that RSR-2295 (EAGRSANHTPAGLTGP) (SEQ ID NO:7048) is cleaved by legumain.
257. A pharmaceutical composition comprising the isolated polypeptide of any one of embodiments 246-257, and at least one pharmaceutically acceptable excipient.
258. The pharmaceutical composition of embodiment 257, which is in a liquid form or is frozen.
259. The pharmaceutical composition of embodiment 257, which is formulated as a lyophilized powder or cake to be reconstituted prior to administration.
260. An injection device comprising the pharmaceutical composition of embodiment 259.
261. The injection device of embodiment 260, which comprises a syringe.
262. A polynucleotide sequence encoding the isolated polypeptide of any one of embodiments 246-257.
263. An expression vector comprising the polynucleotide sequence of embodiment 262.
264. A host cell comprising the expression vector of embodiment 263.
265. A method of producing the isolated polypeptide of any one of embodiments 246-257.
266. The method of embodiment 265, further comprising isolating the isolated polypeptide from a host cell.
267. A fusion protein comprising a protease-cleavable amino acid sequence comprising the sequence: EAGRSAXHTPAGLTGP (SEQ ID NO: 7627), wherein X is any amino acid other than N, wherein the protease-cleavable amino acid sequence links a first polypeptide moiety to a second polypeptide moiety.
268. The fusion protein of embodiment 267, wherein X is S.
269. The fusion protein of embodiment 267, which is not cleavable by legumain.
270. The fusion protein of embodiment 267, which is not cleavable by legumain in human blood, plasma, or serum.
271. The fusion protein of embodiment 267, which is not cleavable upon incubation with about 1 nM or less legumain for about 20 hours.
272. The fusion protein of embodiment 267, which is not cleavable upon incubation with about 1 nM or less legumain for about 20 hours in human blood, plasma, or serum.
273. The fusion protein of embodiment 267, wherein legumain cleaves the protease-cleavable amino acid sequence in human plasma at a rate that is less than about 50% of the rate that RSR-2295 (EAGRSANHTPAGLTGP) (SEQ ID NO:7048) is cleaved by legumain.
274. The fusion protein of embodiment 267, wherein legumain cleaves the protease-cleavable amino acid sequence in human plasma at a rate that is less than about 25% of the rate that RSR-2295 (EAGRSANHTPAGLTGP) (SEQ ID NO:7048) is cleaved by legumain.
275. The fusion protein of embodiment 267, wherein legumain cleaves the protease-cleavable amino acid sequence in human plasma at a rate that is less than about 10% of the rate that RSR-2295 (EAGRSANHTPAGLTGP) (SEQ ID NO:7048) is cleaved by legumain.
276. The fusion protein of embodiment 267, wherein legumain cleaves the protease-cleavable amino acid sequence in human plasma at a rate that is less than about 5% of the rate that RSR-2295 (EAGRSANHTPAGLTGP) (SEQ ID NO:7048) is cleaved by legumain.
277. The fusion protein of embodiment 267, wherein legumain cleaves the protease-cleavable amino acid sequence in human plasma at a rate that is less than about 2.5% of the rate that RSR-2295 (EAGRSANHTPAGLTGP) (SEQ ID NO:7048) is cleaved by legumain.
278. The fusion protein of any one of embodiments 267-278, wherein the first polypeptide moiety comprises an antigen-binding domain and the second polypeptide moiety comprises a masking polypeptide.
279. The fusion protein of any one of embodiments 267-278, wherein the first polypeptide moiety comprises an antigen-binding domain and the second polypeptide moiety is a cytokine, an enzyme, a hormone, a growth factor, a chemotherapeutic polypeptide, an antiviral polypeptide, or a toxin.
280. The fusion protein of any one of embodiments 267-278, wherein the first polypeptide moiety is a cytokine, an enzyme, a hormone, a growth factor, a chemotherapeutic polypeptide, an antiviral polypeptide, or a toxin and the second polypeptide moiety is a masking polypeptide.
281. The fusion protein of embodiment 280, wherein the masking polypeptide comprises an ELNN.
282. The fusion protein of any one of embodiments 267-281, comprising a single polypeptide chain, which comprises, in the N terminal to C terminal direction, the first polypeptide then the protease-cleavable amino acid sequence then the second polypeptide moiety.
283. The fusion protein of any one of embodiments 267-281, comprising a single polypeptide chain, which comprises, in the N terminal to C terminal direction, the second polypeptide then the protease-cleavable amino acid sequence then the first polypeptide moiety.
284. A pharmaceutical composition comprising the fusion protein of any one of embodiments 267-283, and at least one pharmaceutically acceptable excipient.
285. The pharmaceutical composition of embodiment 284, which is in a liquid form or is frozen.
286. The pharmaceutical composition of embodiment 284, which is formulated as a lyophilized powder or cake to be reconstituted prior to administration.
287. An injection device comprising the pharmaceutical composition of embodiment 284.
288. The injection device of embodiment 287, which comprises a syringe.

289. A polynucleotide sequence encoding the fusion protein of any one of embodiments 267-283.
290. An expression vector comprising the polynucleotide sequence of embodiment 289.
291. A host cell comprising the expression vector of embodiment 290.
292. A method of producing the fusion protein of any one of embodiments 267-283.
293. The method of embodiment 275, further comprising isolating the fusion protein from a host cell.
294. An ELNN polypeptide comprising the following amino acid sequence:

```
                                      (SEQ ID NO: 8021)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATP.
```

295. An ELNN polypeptide comprising the following amino acid sequence:

```
                                      (SEQ ID NO: 8022)
ATPESGPGTSESATPESGPGSPAGSPTSTEEGTSESATPESGPGSEPATS

GSETPGTSESATPESGPGTSTEPSEGSAPGTSTEPSEGSAPGTSTEPSEG

SAPGTSTEPSEGSAPGTSTEPSEGSAPGTSTEPSEGSAPGSPAGSPTSTE

EGTSTEPSEGSAPGTSESATPESGPGSEPATSGSETPGTSESATPESGPG

SEPATSGSETPGTSESATPESGPGTSTEPSEGSAPGTSESATPESGPGSP

AGSPTSTEEGSPAGSPTSTEEGSPAGSPTSTEEGTSESATPESGPGTSTE

PSEGSAPGTSESATPESGPGSEPATSGSETPGTSESATPESGPGSEPATS

GSETPGTSESATPESGPGTSTEPSEGSAPGSPAGSPTSTEEGTSESATPE

SGPGSEPATSGSETPGTSESATPESGPGSPAGSPTSTEEGSPAGSPTSTE

EGTSTEPSEGSAPGTSESATPESGPGTSESATPESGPGTSPSATPESGPG

SEPATSGSETPGSEPATSGSETPGSPAGSPTSTEEGTSTEPSEGSAPGTS

TEPSEGSAPGSEPATSGSETPGTSESAGEPEA.
```

296. A fusion protein comprising the ELNN polypeptide of embodiment 294 or 295.
297. A pharmaceutical composition comprising the ELNN polypeptide of embodiment 294 or 295, or the fusion protein of any one of embodiments 267-283 and 296, and at least one pharmaceutically acceptable excipient.
298. The pharmaceutical composition of embodiment 297, which is in a liquid form or is frozen.
299. The pharmaceutical composition of embodiment 297, which is formulated as a lyophilized powder or cake to be reconstituted prior to administration.
300. An injection device comprising the pharmaceutical composition of embodiment 297.
301. The injection device of embodiment 300, which comprises a syringe.
302. A polynucleotide sequence encoding the ELNN polypeptide of embodiment 294 or 295, or the fusion protein of any one of embodiments 267-283 and 296.
303. An expression vector comprising the polynucleotide sequence of embodiment 302.
304. A host cell comprising the expression vector of embodiment 303.
305. A method of producing the ELNN polypeptide of embodiment 294 or 295, or the fusion protein of any one of embodiments 267-283 and 296.
306. The method of embodiment 305, further comprising isolating the ELNN polypeptide or the fusion protein, from a host cell.
307. A barcode fragment comprising an amino acid sequence that has at least 85%, 90%, 91%, 92%, 93%, 94%, 95%, 96%, 97%, 98%, or 99% identity, or 100% identity, to

```
                           (SEQ ID NO: 1010)
SGPGTGTSATPE,
                           (SEQ ID NO: 78)
SGPGSGPGTSE,
                           (SEQ ID NO: 1011)
SGPGTTPGTTPE,
                           (SEQ ID NO: 1012)
SGPGTPPTSTPE,
                           (SEQ ID NO: 79)
SGPGTSPSATPE,
                           (SEQ ID NO: 1013)
SGPGTGSAGTPE,
                           (SEQ ID NO: 1014)
SGPGTGGAGTPE,
                           (SEQ ID NO: 1015)
SGPGTSPGATPE,
                           (SEQ ID NO: 1016)
SGPGTSGSGTPE,
                           (SEQ ID NO: 1017)
SGPGTSSASTPE,
                           (SEQ ID NO: 1018)
SGPGTGAGTTPE,
                           (SEQ ID NO: 1019)
SGPGTGSTSTPE,
                           (SEQ ID NO: 1020)
TPGSEPATSGSE,
                           (SEQ ID NO: 1021)
GSAPGTSTEPSE,
                           (SEQ ID NO: 1022)
SGPGTAGSGTPE,
                           (SEQ ID NO: 1023)
SGPGTSSGGTPE,
                           (SEQ ID NO: 1024)
SGPGTAGPATPE,
                           (SEQ ID NO: 1025)
SGPGTPGTGTPE,
                           (SEQ ID NO: 1026)
SGPGTGGPTTPE,
or
                           (SEQ ID NO: 1027)
SGPGTGSGSTPE.
```

308. A barcode fragment comprising an amino acid sequence that has at least 85%, 90%, 91%, 92%, 93%, 94%, 95%, 96%, 97%, 98%, or 99% identity, or 100% identity, to SGPGSGPGTSE (SEQ ID NO:78) or SGPGTSPSATPE (SEQ ID NO:79).
309. The barcode fragment of embodiment 307 or 308, comprising the amino acid sequence: SGPGSGPGTSE (SEQ ID NO:78).
310. The barcode fragment of embodiment 307 or 308, comprising the amino acid sequence: SGPGTSPSATPE (SEQ ID NO:79).
311. A fusion protein comprising the barcode fragment of any one of embodiments 307-310.
312. A fusion protein comprising a Glu-C cleavage site comprising one of the following amino acid sequences: ATPESGPG (SEQ ID NO:9020), SGSETPGT (SEQ ID NO:9021), and GTSESATP (SEQ ID NO:9022).

313. A fusion protein comprising at least one of the following amino acid sequences: SGPE.SGPGX$_n$SGPE.SGPG (SEQ ID NO:9023), SGPE.SGPGX$_n$ATPE.SGPG (SEQ ID NO:9024), SGPE.SGPGX$_n$GTSE.SATP (SEQ ID NO:9025), SGPE.SGPGX$_n$TTPE.SGPG (SEQ ID NO:9026), SGPE.SGPGX$_n$STPE.SGPG (SEQ ID NO:9027), SGPE.SGPGX$_n$GTPE.SGPG (SEQ ID NO:9028), SGPE.SGPGX$_n$GTPE.TPGS (SEQ ID NO:9029), SGPE.SGPGX$_n$GTPE.TPGS (SEQ ID NO:9029), SGPE.SGPGX$_n$SGSE.TGTP (SEQ ID NO:9030), SGPE.SGPGX$_n$GTPE.GSAP (SEQ ID NO:9031), SGPE.SGPGX$_n$EPSE.SATP (SEQ ID NO:9032), ATPE.SGPGX$_n$SGPE.SGPG (SEQ ID NO:9033), ATPE.SGPGX$_n$ATPE.SGPG (SEQ ID NO:9034), ATPE.SGPGX$_n$GTSE.SATP (SEQ ID NO:9035), ATPE.SGPGX$_n$TTPE.SGPG (SEQ ID NO:9036), ATPE.SGPGX$_n$STPE.SGPG (SEQ ID NO:9037), ATPE.SGPGX$_n$GTPE.SGPG (SEQ ID NO:9043), ATPE.SGPGX$_n$GTPE.TPGS (SEQ ID NO:9045), ATPE.SGPGX$_n$SGSE.TGTP (SEQ ID NO:9046), ATPE.SGPGX$_n$GTPE.GSAP (SEQ ID NO:9047), ATPE.SGPGX$_n$EPSE.SATP (SEQ ID NO:9048), GTSE.SATPX$_n$SGPE.SGPG (SEQ ID NO:9049), GTSE.SATPX$_n$ATPE.SGPG (SEQ ID NO:9050), GTSE.SATPX$_n$GTSE.SATP (SEQ ID NO:9051), GTSE.SATPX$_n$TTPE.SGPG (SEQ ID NO:9052), GTSE.SATPX$_n$STPE.SGPG (SEQ ID NO:9053), GTSE.SATPX$_n$GTPE.SGPG (SEQ ID NO:9054), GTSE.SATPX$_n$GTPE.TPGS (SEQ ID NO:9055), GTSE.SATPX$_n$SGSE.TGTP (SEQ ID NO:9056), GTSE.SATPX$_n$GTPE.GSAP (SEQ ID NO:9057), GTSE.SATPX$_n$EPSE.SATP (SEQ ID NO:9058), TTPE.SGPGX$_n$SGPE.SGPG (SEQ ID NO:9059), TTPE.SGPGX$_n$ATPE.SGPG (SEQ ID NO:9060), TTPE.SGPGX$_n$GTSE.SATP (SEQ ID NO:9061), TTPE.SGPGX$_n$TTPE.SGPG (SEQ ID NO:9062), TTPE.SGPGX$_n$STPE.SGPG (SEQ ID NO:9064), TTPE.SGPGX$_n$GTPE.SGPG (SEQ ID NO:9065), TTPE.SGPGX$_n$GTPE.TPGS (SEQ ID NO:9066), TTPE.SGPGX$_n$SGSE.TGTP (SEQ ID NO:9067), TTPE.SGPGX$_n$GTPE.GSAP (SEQ ID NO:9068), TTPE.SGPGX$_n$EPSE.SATP (SEQ ID NO:9069), STPE.SGPGX$_n$SGPE.SGPG (SEQ ID NO:9070), STPE.SGPGX$_n$ATPE.SGPG (SEQ ID NO:9071), STPE.SGPGX$_n$GTSE.SATP (SEQ ID NO:9072), STPE.SGPGX$_n$TTPE.SGPG (SEQ ID NO:9073), STPE.SGPGX$_n$STPE.SGPG (SEQ ID NO:9074), STPE.SGPGX$_n$GTPE.SGPG (SEQ ID NO:9076), STPE.SGPGX$_n$GTPE.TPGS (SEQ ID NO:9077), STPE.SGPGX$_n$SGSE.TGTP (SEQ ID NO:9078), STPE.SGPGX$_n$GTPE.GSAP (SEQ ID NO:9079), STPE.SGPGX$_n$ EPSE.SATP (SEQ ID NO:9175), GTPE.SGPGX$_n$SGPE.SGPG (SEQ ID NO:9081), GTPE.SGPGX$_n$ATPE.SGPG (SEQ ID NO:9082), GTPE.SGPGX$_n$GTSE.SATP (SEQ ID NO:9083), GTPE.SGPGX$_n$TTPE.SGPG (SEQ ID NO:9084), GTPE.SGPGX$_n$STPE.SGPG (SEQ ID NO:9086), GTPE.SGPGX$_n$GTPE.SGPG (SEQ ID NO:9088), GTPE.SGPGX$_n$GTPE.TPGS (SEQ ID NO:9090), GTPE.SGPGX$_n$SGSE.TGTP (SEQ ID NO:9091), GTPE.SGPGX$_n$GTPE.GSAP (SEQ ID NO:9092), GTPE.SGPGX$_n$EPSE.SATP (SEQ ID NO:9093), GTPE.TPGSX$_n$SGPE.SGPG (SEQ ID NO:9094), GTPE.TPGSX$_n$ATPE.SGPG (SEQ ID NO:9095), GTPE.TPGSX$_n$GTSE.SATP (SEQ ID NO:9096), GTPE.TPGSX$_n$TTPE.SGPG (SEQ ID NO:9097), GTPE.TPGSX$_n$STPE.SGPG (SEQ ID NO:9098), GTPE.TPGSX$_n$GTPE.SGPG (SEQ ID NO:9099), GTPE.TPGSX$_n$GTPE.TPGS (SEQ ID NO:9100), GTPE.TPGSX$_n$SGSE.TGTP (SEQ ID NO:9101), GTPE.TPGSX$_n$GTPE.GSAP (SEQ ID NO:9103), GTPE.TPGSX$_n$EPSE.SATP (SEQ ID NO:9104), SGSE.TGTPX$_n$SGPE.SGPG (SEQ ID NO:9105), SGSE.TGTPX$_n$ATPE.SGPG (SEQ ID NO:9106), SGSE.TGTPX$_n$GTSE.SATP (SEQ ID NO:9107), SGSE.TGTPX$_n$TTPE.SGPG (SEQ ID NO:9108), SGSE.TGTPX$_n$STPE.SGPG (SEQ ID NO:9109), SGSE.TGTPX$_n$GTPE.SGPG (SEQ ID NO:9110), SGSE.TGTPX$_n$GTPE.TPGS (SEQ ID NO:9111), SGSE.TGTPX$_n$SGSE.TGTP (SEQ ID NO:9112), SGSE.TGTPX$_n$GTPE.GSAP (SEQ ID NO:9113), SGSE.TGTPX$_n$EPSE.SATP (SEQ ID NO:9114), GTPE.GSAPX$_n$SGPE.SGPG (SEQ ID NO:9115), GTPE.GSAPX$_n$ATPE.SGPG (SEQ ID NO:9116), GTPE.GSAPX$_n$GTSE.SATP (SEQ ID NO:9117), GTPE.GSAPX$_n$TTPE.SGPG (SEQ ID NO:9118), GTPE.GSAPX$_n$STPE.SGPG (SEQ ID NO:9119), GTPE.GSAPX$_n$GTPE.SGPG (SEQ ID NO:9120), GTPE.GSAPX$_n$GTPE.TPGS (SEQ ID NO:9121), GTPE.GSAPX$_n$SGSE.TGTP (SEQ ID NO:9122), GTPE.GSAPX$_n$GTPE.GSAP (SEQ ID NO:9123), GTPE.GSAPX$_n$EPSE.SATP (SEQ ID NO:9124), EPSE.SATPX$_n$SGPE.SGPG (SEQ ID NO:9126), EPSE.SATPX$_n$ATPE.SGPG (SEQ ID NO:9127), EPSE.SATPX$_n$GTSE.SATP (SEQ ID NO:9128), EPSE.SATPX$_n$TTPE.SGPG (SEQ ID NO:9129), EPSE.SATPX$_n$STPE.SGPG (SEQ ID NO:9130), EPSE.SATPX$_n$GTPE.SGPG (SEQ ID NO:9131), EPSE.SATPX$_n$GTPE.TPGS (SEQ ID NO:9132), EPSE.SATPX$_n$SGSE.TGTP (SEQ ID NO:9133), EPSE.SATPX$_n$GTPE.GSAP (SEQ ID NO:9134), or EPSE.SATPX$_n$EPSE.SATP (SEQ ID NO:9135), wherein each "." is a Glu-C cleavage site and n is any integer from 0 to 50.

314. The fusion protein of embodiment 313, comprising at least one of the following amino acid sequences: SGPE.SGPGX$_n$ATPE.SGPG (SEQ ID NO:9038), ATPE.SGPGX$_n$GTSE.SATP (SEQ ID NO:9040), ATPE.SGPGX$_n$TTPE.SGPG (SEQ ID NO:9041), ATPE.SGPGX$_n$STPE.SGPG (SEQ ID NO:9042), ATPE.SGPGX$_n$ATPE.SGPG (SEQ ID NO:9039), ATPE.SGPGX$_n$GTPE.SGPG (SEQ ID NO:9044), ATPE.SGPGX$_n$GTPE.SGPG (SEQ ID NO:9044), ATPE.SGPGX$_n$ATPE.SGPG (SEQ ID NO:9039), GTPE.SGPGX$_n$GTPE.SGPG (SEQ ID NO:9089), GTPE.SGPGX$_n$STPE.SGPG (SEQ ID NO:9087), GTPE.SGPGX$_n$TTPE.SGPG (SEQ ID NO:9085), GTPE.SGPGX$_n$STPE.SGPG (SEQ ID NO:9087), GTPE.TPGSX$_n$SGSE.TGTP (SEQ ID NO:9102), GTPE.GSAPX$_n$EPSE.SATP (SEQ ID NO:9125), ATPE.SGPGX$_n$GTPE.SGPG (SEQ ID NO:9044), ATPE.SGPGX$_n$GTPE.SGPG (SEQ ID NO:9044), ATPE.SGPGX$_n$ATPE.SGPG (SEQ ID NO:9039), ATPE.SGPGX$_n$GTPE.SGPG (SEQ ID NO:9044), TTPE.SGPGX$_n$TTPE.SGPG (SEQ ID NO:9063), or STPE.SGPGX$_n$STPE.SGPG (SEQ ID NO:9075), wherein each "." is a Glu-C cleavage site and n is any integer from 0 to 30.

315. The fusion protein of embodiment 313 or 314, wherein n is any integer from 1 to 20.

316. The fusion protein of embodiment 315, wherein n is any integer from 5 to 15.

317. The fusion protein of embodiment 315, wherein n is any integer from 3 to 7.
318. The fusion protein of embodiment 315, wherein n is any integer from 5 to 10.
319. The fusion protein of embodiment 315, wherein n is 9.
320. The fusion protein of embodiment 315, wherein n is 4.
321. The fusion protein of any one of embodiments 313-320, wherein $X_n$ is PGTGTSAT (SEQ ID NO:9136), PGSGPGT (SEQ ID NO:9137), PGTTPGTT (SEQ ID NO:9138), PGTPPTST (SEQ ID NO:9139), PGTSPSAT (SEQ ID NO:9140), PGTGSAGT (SEQ ID NO:9141), PGTGGAGT (SEQ ID NO:9142), PGTSPGAT (SEQ ID NO:9143), PGTSGSGT (SEQ ID NO:9144), PGTSSAST (SEQ ID NO:9145), PGTGAGTT (SEQ ID NO:9146), PGTGSTST (SEQ ID NO:9147), GSEPATSG (SEQ ID NO:9148), APGTSTEP (SEQ ID NO:9149), PGTAGSGT (SEQ ID NO:9150), PGTSSGGT (SEQ ID NO:9151), PGTAGPAT (SEQ ID NO:9152), PGTPGTGT (SEQ ID NO:9153), PGTGGPTT (SEQ ID NO:9154), or PGTGSGST (SEQ ID NO:9155).
322. The fusion protein of any one of embodiments 313-320, wherein $X_n$ is TGTS (SEQ ID NO:9156), SGP, TTPG (SEQ ID NO:9157), TPPT (SEQ ID NO:9158), TSPS (SEQ ID NO:9159), TGSA (SEQ ID NO:9160), TGGA (SEQ ID NO:9161), TSPG (SEQ ID NO:9162), TSGS (SEQ ID NO:9163), TSSA (SEQ ID NO:9164), TGAG (SEQ ID NO:9165), TGST (SEQ ID NO:9166), EPAT (SEQ ID NO:9167), GTST (SEQ ID NO:9168), TAGS (SEQ ID NO:9169), TSSG (SEQ ID NO:9170), TAGP (SEQ ID NO:9171), TPGT (SEQ ID NO:9172), TGGP (SEQ ID NO:9173), or TGSG (SEQ ID NO:9174).
323. A pharmaceutical composition comprising the barcode fragment of any one of embodiments 307-310, or the fusion protein of any one of embodiments 311-322, and at least one pharmaceutically acceptable excipient.
324. The pharmaceutical composition of embodiment 323, which is in a liquid form or is frozen.
325. The pharmaceutical composition of embodiment 323, which is formulated as a lyophilized powder or cake to be reconstituted prior to administration.
326. An injection device comprising the pharmaceutical composition of embodiment 323.
327. The injection device of embodiment 326, which comprises a syringe.
328. A polynucleotide sequence encoding the barcode fragment of any one of embodiments 307-310, or the fusion protein of any one of embodiments 311-322.
329. An expression vector comprising the polynucleotide sequence of embodiment 328.
330. A host cell comprising the expression vector of embodiment 329.
331. A method of producing the barcode fragment of any one of embodiments 307-310, or the fusion protein of any one of embodiments 311-322.
332. The method of embodiment 331, further comprising isolating the barcode fragment or the fusion protein from a host cell.
333. An antibody or an antigen-binding fragment thereof that specifically binds PSMA, comprising a VHH domain or a fragment thereof comprising three VHH CDRs, wherein the three VHH CDRs comprise CDR1, CDR2, and CDR3 from the following amino acid sequence:

```
                                    (SEQ ID NO: 549)
QVQLVESGGGVVQPGRSLRLSCAASGRTFGIYVWGWFRQAPGKEREFVGA

MSWSGSNRKVSDSVKGRFTISRDNSKNTLYLQMNSLRAEDTAVYYCAASN

KEYGRTWYDFNESDYWGQGTQVTVSS.
```

334. An antibody or an antigen-binding fragment thereof that specifically binds PSMA, comprising the following CDRs:
   a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003);
   a VHH CDR2 with an amino acid sequence that has at least 85%, 90%, 91%, 92%, 93%, 94%, 95%, 96%, 97%, 98%, or 99% identity, or 100% identity, to AMSWSGSNRKVSDSVKG (SEQ ID NO:9004); and
   a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005).
335. The antibody or fragment of embodiment 334, comprising one or more of the following FRs:
   a VHH FR1 with an amino acid sequence that has at least 85%, 90%, 91%, 92%, 93%, 94%, 95%, 96%, 97%, 98%, or 99% identity, or 100% identity, to

```
                                    (SEQ ID NO: 9011)
QVQLVESGGGVVQPGRSLRLSCAAS;
``` a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012);
   a VHH FR3 with an amino acid sequence that has at least 85%, 90%, 91%, 92%, 93%, 94%, 95%, 96%, 97%, 98%, or 99% identity, or 100% identity, to RFTISRDNSKNTLYLQMNSLRAEDTAVYYC (SEQ ID NO:9013); and
   a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).
336. An antibody or an antigen-binding fragment thereof that specifically binds PSMA, comprising the following CDRs:
   a VHH CDR1 with an amino acid sequence that has at least 85%, 90%, 91%, 92%, 93%, 94%, 95%, 96%, 97%, 98%, or 99% identity, or 100% identity, to GRTFGIYVWG (SEQ ID NO:9003);
   a VHH CDR2 with an amino acid sequence that has at least 85%, 90%, 91%, 92%, 93%, 94%, 95%, 96%, 97%, 98%, or 99% identity, or 100% identity, to AMSWSGSNRK (SEQ ID NO:9015); and
   a VHH CDR3 with an amino acid sequence that has at least 85%, 90%, 91%, 92%, 93%, 94%, 95%, 96%, 97%, 98%, or 99% identity, or 100% identity, to AASNKEYGRTWYDFNESDY (SEQ ID NO:9005).
337. The antibody or fragment of embodiment 336, comprising one or more of the following FRs:
   a VHH FR1 with an amino acid sequence that has at least 85%, 90%, 91%, 92%, 93%, 94%, 95%, 96%, 97%, 98%, or 99% identity, or 100% identity to

QVQLVESGGGVVQPGRSLRLSCAAS; (SEQ ID NO: 9011)

- a VHH FR2 with an amino acid sequence that has at least 85%, 90%, 91%, 92%, 93%, 94%, 95%, 96%, 97%, 98%, or 99% identity, or 100% identity, to WFRQAPGKEREFVG (SEQ ID NO:9012);
- a VHH FR3 with an amino acid sequence that has at least 85%, 90%, 91%, 92%, 93%, 94%, 95%, 96%, 97%, 98%, or 99% identity, or 100% identity, to VSDSVKGRFTISRDNSKNTLYLQMNSLRAEDTAVYYC (SEQ ID NO:9016); and
- a VHH FR4 with an amino acid sequence that has at least 85%, 90%, 91%, 92%, 93%, 94%, 95%, 96%, 97%, 98%, or 99% identity, or 100% identity, to WGQGTQVTVSS (SEQ ID NO:9014).

338. An antibody or an antigen-binding fragment thereof that specifically binds PSMA, comprising a VHH comprising an amino acid sequence that has at least 85%, 90%, 91%, 92%, 93%, 94%, 95%, 96%, 97%, 98%, or 99% identity, or 100% identity, to (SEQ ID NO: 549)
QVQLVESGGGVVQPGRSLRLSCAASGRTFGIYVWGWFRQAPGKEREFVGA

MSWSGSNRKVSDSVKGRFTISRDNSKNTLYLQMNSLRAEDTAVYYCAASN

KEYGRTWYDFNESDYWGQGTQVTVSS.

339. The antibody or fragment of any one of embodiments 333-338, which is an isolated antibody or fragment thereof.
340. An antibody or an antigen-binding fragment thereof that specifically binds PSMA, comprising a VHH comprising an amino acid sequence that has at least 85%, 90%, 91%, 92%, 93%, 94%, 95%, 96%, 97%, 98%, or 99% identity, or 100% identity, to the amino acid sequence of PSMA.2, PSMA.3, PSMA.5, PSMA.6, PSMA.262, or PSMA.263.
341. An antibody or an antigen-binding fragment thereof that specifically binds PSMA, comprising a VHH comprising an amino acid sequence that has at least 85%, 90%, 91%, 92%, 93%, 94%, 95%, 96%, 97%, 98%, or 99% identity, or 100% identity, to: QVQLVESGGGVVQPGRSLRLSCAASGRTF-GIYVX$_{17}$GWFRQAPGKEREFVGAX$_{18}$SWSGSNRKVSDSVKGRFTISRDNSKNTLYLQMNSLRAED-TAVYX$_{19}$CX$_{20}$X$_{21}$SNKX$_{22}$YGRTWYDFNESDYWGQGTQVTVSS (SEQ ID NO:9017), wherein X$_{17}$, X$_{18}$, X$_{19}$, X$_{20}$, X$_{21}$, and X$_6$ each, individually, correspond to any naturally occurring amino acid.
342. The antibody or fragment of embodiment 341, wherein X$_{17}$ corresponds to M or W, X$_{18}$ corresponds to M or I, X$_{19}$ corresponds to F or Y, X$_{20}$ corresponds to A or G, X$_{21}$ corresponds to A or G, and/or X$_{22}$ corresponds to L, W, R, D, E, or G.
343. The antibody or fragment of embodiment 341 or 342, wherein the PSMA comprises the following amino acid sequence:

(SEQ ID NO: 1044)
KSSNEATNITPKHNMKAFLDELKAENIKKFLYNFTQIPHLAGTEQNFQLA

KQIQSQWKEFGLDSVELAHYDVLLSYPNKTHPNYISIINEDGNEIFNTSL

FEPPPPGYENVSDIVPPFSAFSPQGMPEGDLVYVNYARTEDFFKLERDMK

INCSGKIVIARYGKVFRGNKVKNAQLAGAKGVILYSDPADYFAPGVKSYP

DGWNLPGGGVQRGNILNLNGAGDPLTPGYPANEYAYRRGIAEAVGLPSIP

VHPIGYYDAQKLLEKMGGSAPPDSSWRGSLKVPYNVGPGFTGNFSTQKVK

MHIHSTNEVTRIYNVIGTLRGAVEPDRYVILGGHRDSWVFGGIDPQSGAA

VVHEIVRSFGTLKKEGWRPRRTILFASWDAEEFGLLGSTEWAEENSRLLQ

ERGVAYINADSSIEGNYTLRVDCTPLMYSLVHNLTKELKSPDEGFEGKSL

YESWTKKSPSPEFSGMPRISKLGSGNDFEVFFQRLGIASGRARYTKNWET

NKFSGYPLYHSVYETYELVEKFYDPMFKYHLTVAQVRGGMVFELANSIVL

PFDCRDYAVVLRKYADKIYSISMKHPQEMKTYSVSFDSLFSAVKNFTEIA

SKFSERLQDFDKSNPIVLRMMNDQLMFLERAFIDPLGLPDRPFYRHVIYA

PSSHNKYAGESFPGIYDALFDIESKVDPSKAWGEVKRQIYVAAFTVQAAA

ETLSEVA.

344. An antibody or an antigen-binding fragment thereof that specifically binds CD3, comprising a VL domain and a VH domain, wherein:

(i) the VL domain comprises the VL CDRs of the amino acid sequence of
(SEQ ID NO: 361)
ELVVTQEPSLTVSPGGTVTLTCRSSNGAVTSSNYANWVQQKPGQAPRGLI

GGTNKRAPGTPARFSGSLLGGKAALTLSGVQPEDEAVYYCALWYPNLWVF

GGGTKLTVL;
or (ii) the VH domain comprises the VH CDRs of the amino acid sequence of
(SEQ ID NO: 361)
EVQLVESGGGIVQPGGSLRLSCAASGFTFSTYAMNWVRQAPGKGLEWVGR

IRTKRNNYATYYADSVKGRFTISRDDSKNTVYLQMNSLKTEDTAVYYCVR

HENFGNSYVSWFAHWGQGTLVTVSS.

345. An anti-CD3 antibody or an antigen-binding fragment thereof, comprising one or more of the following CDRs:
- a VL domain CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1);
- a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4);
- a VL domain CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO:6);
- a VH domain CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12);
- a VH domain CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and/or
- a VH domain CDR3 with an amino acid sequence that has at least 85%, 90%, 91%, 92%, 93%, 94%, 95%, 96%, 97%, 98%, or 99% identity, or 100% identity, to

HENFGNSYVSWFAH. (SEQ ID NO: 10)

346. The antibody or fragment of embodiment 345, comprising one or more of the following FRs:
a VL domain FR1 with an amino acid sequence that has at least 85%, 90%, 91%, 92%, 93%, 94%, 95%, 96%, 97%, 98%, or 99% identity, or 100% identity, to

ELVVTQEPSLTVSPGGTVTLTC; (SEQ ID NO: 51)

a VL domain FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52);
a VL domain FR3 with an amino acid sequence that has at least 85%, 90%, 91%, 92%, 93%, 94%, 95%, 96%, 97%, 98%, or 99% identity, or 100% identity, to

GTPARFSGSLLGGKAALTLSGVQPEDEAVYYC; (SEQ ID NO: 53)

a VL domain FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59);
a VH domain FR1 with an amino acid sequence that has at least 85%, 90%, 91%, 92%, 93%, 94%, 95%, 96%, 97%, 98%, or 99% identity, or 100% identity, to EVQLVESGGGIVQPGGSLRLSCAAS (SEQ ID NO:400);
a VH domain FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO:401);
a VH domain FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and/or
a VH domain FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).
347. The antibody or fragment of embodiment 345 or 346, which comprises a VL domain.
348. The antibody or fragment of embodiment 347, wherein the VL domain comprises an amino acid sequence that has at least 85%, 90%, 91%, 92%, 93%, 94%, 95%, 96%, 97%, 98%, or 99% identity, or 100% identity, to:

(SEQ ID NO: 361)
ELVVTQEPSLTVSPGGTVTLTCRSSNGAVTSSNYANWVQQKPGQAPRGLI

GGTNKRAPGTPARFSGSLLGGKAALTLSGVQPEDEAVYYCALWYPNLWVF

GGGTKLTVL.

349. The antibody or fragment of any one of embodiments 345-348, which comprises a VH domain.
350. The antibody or fragment of embodiment 349, wherein the VH domain comprises an amino acid sequence that has at least 85%, 90%, 91%, 92%, 93%, 94%, 95%, 96%, 97%, 98%, or 99% identity, or 100% identity, to:

(SEQ ID NO: 311)
EVQLVESGGGIVQPGGSLRLSCAASGFTFSTYAMNWVRQAPGKGLEWVGR

IRTKRNNYATYYADSVKGRFTISRDDSKNTVYLQMNSLKTEDTAVYYCVR

HENFGNSYVSWFAHWGQGTLVTVSS.

351. An antibody or an antigen-binding fragment thereof that specifically binds CD3, comprising a VL domain and a VH domain, wherein the VL domain amino acid sequence SEQ ID NO/VH domain amino acid sequence SEQ ID NO pair is selected from the group consisting of: 896/897; 902/903; 700/701; 702/703; 716/717; 718/719; 728/729; 736/737; 738/739; 740/741; 742/743; 744/745; 746/747; 748/749; 750/751; 752/753; 754/755; 756/757; 758/759; 760/761; 762/763; 764/765; 766/767; 774/775; 776/777; 790/791; 792/793; 798/799; 800/801; 806/807; 808/809; 814/815; 816/817; 822/823; 824/825; or 826/867.
352. The antibody or fragment thereof of any one of embodiments 340-351, which is an isolated antibody or fragment thereof.
353. The antibody or fragment of any one of embodiments 333-352, which is an antibody.
354. The antibody of embodiment 353, which is a Fab, an scFV, or a monoclonal antibody.
355. The antibody of embodiment 354, which is an scFV.
356. The antibody of embodiment 355, wherein the VL domain is N-terminal to the VH domain in the scFV.
357. The antibody of embodiment 355, wherein the VL domain is C-terminal to the VH domain in the scFV.
358. The antibody of any one of embodiments 353-357, wherein the scFv comprises a linker between the VL domain and the VH domain, wherein the linker consists of A, E, G, S, P, and/or T residues.
359. The antibody of embodiment 358, wherein the linker is an ELNN.
360. The antibody of embodiment 359, wherein the ELNN is cleavable by a non-mammalian protease.
361. The antibody of embodiment 360, wherein the non-mammalian protease is Glu-C.
362. The antibody of embodiment 361, wherein ELNN comprises an amino acid sequence that has at least 85%, 90%, 91%, 92%, 93%, 94%, 95%, 96%, 97%, 98%, or 99% identity, or 100% identity, to SESAT-PESGPGTSPGATPESGPGTSESATP (SEQ ID NO: 81).
363. The antibody of embodiment 355, wherein the scFV comprises an amino acid sequence that has at least 85%, 90%, 91%, 92%, 93%, 94%, 95%, 96%, 97%, 98%, or 99% identity, or 100% identity, to:

(SEQ ID NO: 215)
ELVVTQEPSLTVSPGGTVTLTCRSSNGAVTSSNYANWVQQKPGQAPRGLI

GGTNKRAPGTPARFSGSLLGGKAALTLSGVQPEDEAVYYCALWYPNLWVF

GGGTKLTVLSESATPESGPGTSPGATPESGPGTSESATPEVQLVESGGGI

VQPGGSLRLSCAASGFTFSTYAMNWVRQAPGKGLEWVGRIRTKRNNYATY

YADSVKGRFTISRDDSKNTVYLQMNSLKTEDTAVYYCVRHENFGNSYVSW

FAHWGQGTLVTVSS.

364. The antibody or fragment of any one of embodiments 344-364, wherein the CD3 is CD3 epsilon.

365. The antibody or fragment of embodiment 364, wherein the CD3 epsilon comprises the following amino acid sequence:

(SEQ ID NO: 1043)
DGNEEMGGITQTPYKVSISGTTVILTCPQYPGSEILWQHNDKNIGGDEDD

KNIGSDEDHLSLKEFSELEQSGYYVCYPRGSKPEDANFYLYLRARVCENC

MEMD

366. A pharmaceutical composition comprising the antibody or an antigen-binding fragment thereof of any one of embodiments 333-365, and at least one pharmaceutically acceptable excipient.

367. The pharmaceutical composition of embodiment 366, which is in a liquid form or is frozen.

368. The pharmaceutical composition of embodiment 366, which is formulated as a lyophilized powder or cake to be reconstituted prior to administration.

369. An injection device comprising the pharmaceutical composition of embodiment 366.

370. The injection device of embodiment 369, which comprises a syringe.

371. A polynucleotide sequence encoding the antibody or an antigen-binding fragment thereof of any one of embodiments 333-365.

372. An expression vector comprising the polynucleotide sequence of embodiment 371.

373. A host cell comprising the expression vector of embodiment 372.

374. A method of producing the antibody or an antigen-binding fragment thereof of any one of embodiments 333-365.

375. The method of embodiment 374, further comprising isolating the antibody or an antigen-binding fragment thereof of from a host cell.

376. A multispecific antibody comprising an anti-PSMA antibody domain comprising an antibody or antibody fragment according to any one of embodiments 333-343 and/or an anti-CD3 antibody domain comprising an antibody or antibody fragment according to any one of embodiments 344-365.

377. A multispecific antibody comprising an anti-PSMA antibody domain comprising an antibody or antibody fragment according to any one of embodiments 333-343 and an anti-CD3 antibody domain comprising an antibody or antibody fragment according to any one of embodiments 344-365.

378. The multispecific antibody of embodiment 376 or 377, wherein the affinity of the anti-PSMA antibody domain to PSMA is higher than the affinity of the anti-CD3 antibody domain to CD3.

379. The multispecific antibody of any one of embodiments 375-378, which is a bispecific antibody.

380. The bispecific antibody of embodiment 379, which is a T cell engager.

381. A pharmaceutical composition comprising the multispecific antibody of any one of embodiments 375-380, and at least one pharmaceutically acceptable excipient.

382. The pharmaceutical composition of embodiment 381, which is in a liquid form or is frozen.

383. The pharmaceutical composition of embodiment 381, which is formulated as a lyophilized powder or cake to be reconstituted prior to administration.

384. An injection device comprising the pharmaceutical composition of embodiment 381.

385. The injection device of embodiment 384, which comprises a syringe.

386. A polynucleotide sequence encoding the multispecific antibody of any one of embodiments 375-380.

387. An expression vector comprising the polynucleotide sequence of embodiment 386.

388. A host cell comprising the expression vector of embodiment 387.

389. A method of producing the multispecific antibody of any one of embodiments 375-380.

390. The method of embodiment 389, further comprising isolating the multispecific antibody from a host cell.

391. A T cell engager comprising a first antigen binding domain that binds to prostate-specific membrane antigen (PSMA) and a second antigen binding domain that binds to cluster of differentiation 3 T cell receptor (CD3), wherein the first antigen binding domain comprises a VHH comprising an amino acid sequence that has at least 85%, 90%, 91%, 92%, 93%, 94%, 95%, 96%, 97%, 98%, or 99% identity, or 100% identity, to QVQLVESGGGVVQPGRSLRLSCAAS-GRTFGIYVWGWFRQAPGKEREFVGAMSWSG-SNRKV SDSVKGRFTISRDNSKNTLYLQMNSL-RAEDTAVYYCAASNKEYGRTWYDFNESDY-WGQGTQ VTVSS (SEQ ID NO: 549); and the second antigen binding domain comprises a VL domain comprising an amino acid sequence that has at least 85%, 90%, 91%, 92%, 93%, 94%, 95%, 96%, 97%, 98%, or 99% identity, or 100% identity, to ELVVTQEPSLTVSPGGTVTLTCRSSN-GAVTSSNYANWVQQKPGQAPRGLIGGTNK-RAPGTPA RFSGSLLGGKAALTLSGVQ-PEDEAVYYCALWYPNLWVFGGGTKLTVL (SEQ ID NO: 361) and a VH domain comprising an amino acid sequence that has at least 85%, 90%, 91%, 92%, 93%, 94%, 95%, 96%, 97%, 98%, or 99% identity, or 100% identity, to (SEQ ID NO: 311)
EVQLVESGGGIVQPGGSLRLSCAASGFTFSTYAMNWVRQAPGKGLEWVGR

IRTKRNNYATYYADSVKGRFTISRDDSKNTVYLQMNSLKTEDTAVYYCVR

HENFGNSYVSWFAHWGQGTLVTVSS.

392. A pharmaceutical composition comprising the T cell engager of embodiment 391, and at least one pharmaceutically acceptable excipient.

393. The pharmaceutical composition of embodiment 392, which is in a liquid form or is frozen.

394. The pharmaceutical composition of embodiment 392, which is formulated as a lyophilized powder or cake to be reconstituted prior to administration.

395. An injection device comprising the pharmaceutical composition of embodiment 392.

396. The injection device of embodiment 395, which comprises a syringe.

397. A polynucleotide sequence encoding the T cell engager of embodiment 391.

398. An expression vector comprising the polynucleotide sequence of embodiment 397.

399. A host cell comprising the expression vector of embodiment 398.
400. A method of producing the T cell engager of embodiment 391.
401. The method of embodiment 400, further comprising isolating the T cell engager from a host cell.
402. A protease-activatable T cell engager (paTCE) comprising a T cell engager (TCE) according embodiment 391, in the form of a single polypeptide chain, wherein the N-terminus of the TCE is fused to a first masking polypeptide by a first protease-cleavable linker and the C-terminus of the TCE is fused to a second masking polypeptide by a second protease-cleavable linker.
403. The paTCE of embodiment 402, wherein the first masking polypeptide is a first ELNN.
404. The paTCE of embodiment 402 or 402, wherein the second masking polypeptide is a second ELNN.
405. The paTCE of any one of embodiments 402-404, wherein TCE comprises an anti-PSMA VHH comprising the following amino acid sequence:

(SEQ ID NO: 549)
QVQLVESGGGVVQPGRSLRLSCAASGRTFGIYVWGWFRQAPGKEREFVGA

MSWSGSNRKVSDSVKGRFTISRDNSKNTLYLQMNSLRAEDTAVYYCAASN

KEYGRTWYDFNESDYWGQGTQVTVSS.

406. The paTCE of any one of embodiments 402-405, wherein TCE comprises an anti-CD3 scFv comprising a VH domain having the following amino acid sequence: EVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVS S (SEQ ID NO: 311) and a VL domain having the following amino acid sequence:

(SEQ ID NO: 361)
ELVVTQEPSLTVSPGGTVTLTCRSSNGAVTSSNYANWVQQKPGQAPRGLI

GGTNKRAPGTPARFSGSLLGGKAALTLSGVQPEDEAVYYCALWYPNLWVF

GGGTKLTVL.

407. A pharmaceutical composition comprising the paTCE of any one of embodiments 402-406, and at least one pharmaceutically acceptable excipient.
408. The pharmaceutical composition of embodiment 407, which is in a liquid form or is frozen.
409. The pharmaceutical composition of embodiment 407, which is formulated as a lyophilized powder or cake to be reconstituted prior to administration.
410. An injection device comprising the pharmaceutical composition of embodiment 409.
411. The injection device of embodiment 410, which comprises a syringe.
412. A polynucleotide sequence encoding the paTCE of any one of embodiments 402-406.
413. An expression vector comprising the polynucleotide sequence of embodiment 412.
414. A host cell comprising the expression vector of embodiment 413.
415. A method of producing the paTCE of any one of embodiments 402-406.
416. The method of embodiment 415, further comprising isolating the paTCE from a host cell.
417. A chimeric polypeptide, isolated polypeptide, fusion protein, antigen binding polypeptide, antibody or an antigen-binding fragment thereof that specifically binds PSMA, antibody or an antigen-binding fragment thereof that specifically binds CD3, multispecific antibody, T cell engager, or paTCE, produced by the method of any one of embodiments 208, 209, 244, 245, 26, 266, 292, 293, 305, 306, 331, 332, 374, 375, 389, 390, 400, 401, 415, or 416.
418. A polynucleotide sequence encoding the amino acid sequence: EAGRSAXHTPAGLTGP (SEQ ID NO: 7627), wherein X is any amino acid other than N.
419. The polynucleotide of embodiment 418, which is a vector.
420. The polynucleotide of embodiment 418, which is an isolated polynucleotide.
421. A cell line that expresses an exogenous polypeptide comprising the amino acid sequence: EAGRSAXHTPAGLTGP (SEQ ID NO: 7627), wherein X is any amino acid other than N.
422. The cell line of embodiment 421, wherein the exogenous polypeptide is a fusion protein according to any one of embodiments 267-283.
423. The cell line of embodiment 421 or 422, which is in culture or is frozen in a glass or plastic container.
424. The cell line of any one of embodiments 421-423, which is in a bioreactor.
425. The cell line of any one of embodiments 421-424, which is a stable cell line.
426. The cell line of any one of embodiments 421-425, which is a mammalian cell.
427. The cell line of embodiment 426, which is a CHO cell or a HEK293 cell.
428. The cell line of any one of embodiments 421-425, which is a prokaryotic cell.
429. The cell line of embodiment 428, which is an *Escherichia coli* cell.
430. A non-human animal that comprises an exogenous polypeptide comprising the amino acid sequence: EAGRSAXHTPAGLTGP (SEQ ID NO: 7627), wherein X is any amino acid other than N.
431. The polynucleotide sequence of any one of embodiments 418-420, the cell line of any one of embodiments 421-429, or the non-human animal of embodiment 430, wherein X is D, E, or Q.
432. The polynucleotide sequence of any one of embodiments 418-420, the cell line of any one of embodiments 421-429, or the non-human animal of embodiment 430, wherein X is G, A, V, L, I.
433. The polynucleotide sequence of any one of embodiments 418-420, the cell line of any one of embodiments 421-429, or the non-human animal of embodiment 430, wherein X is P.
434. The polynucleotide sequence of any one of embodiments 418-420, the cell line of any one of embodiments 421-429, or the non-human animal of embodiment 430, wherein X is F, Y, or W.
435. The polynucleotide sequence of any one of embodiments 418-420, the cell line of any one of embodiments 421-429, or the non-human animal of embodiment 430, wherein X is H, K, or R.
436. The polynucleotide sequence of any one of embodiments 418-420, the cell line of any one of embodiments 421-429, or the non-human animal of embodiment 430, wherein X is S, C, U, T, or M.

437. The polynucleotide sequence of any one of embodiments 418-420, the cell line of any one of embodiments 421-429, or the non-human animal of embodiment 430, wherein X is S.
438. A fusion protein comprising an anti-PSMA antibody or fragment according to any one of embodiments 333-343 and a biologically active protein.
439. A fusion protein comprising an anti-CD3 antibody or fragment according to any one of embodiments 344-365 and a biologically active protein.
440. The fusion protein of embodiment 438 or 439, wherein the biologically active protein comprises a cytokine, an enzyme, a hormone, a growth factor, a chemotherapeutic polypeptide, an antiviral polypeptide, or a toxin.
441. An immunoconjugate comprising an anti-PSMA antibody or fragment according to any one of embodiments 333-343 and a compound.
442. An immunoconjugate comprising an anti-CD3 antibody or fragment according to any one of embodiments 344-365 and a compound.
443. The immunoconjugate of embodiment 441 or 442, wherein the compound comprises chemotherapeutic agent.
444. The immunoconjugate of embodiment 441 or 442, wherein the compound comprises a diagnostic agent.
445. The immunoconjugate of embodiment 441 or 442, wherein the compound comprises a toxin, a radioactive molecule, a contrast agent, or a drug.

The following are examples of compositions and evaluations of compositions of the disclosure. It is understood that various some embodiments may be practiced, given the general description provided above.

INCORPORATION BY REFERENCE

All publications, patents, and patent applications mentioned in this specification are incorporated herein by reference to the same extent as if each individual publication, patent, or patent application was specifically and individually indicated to be incorporated by reference.

EXAMPLES

Example 1. Production of High Affinity Anti-PSMA VHH Domains

High affinity VHH domains were isolated from immunized llamas through in vitro screening. Multiple VHH domains that bind human PSMA (hPSMA) were identified.

The amino acid sequence of the hPSMA antigen (with an added HHHHHH (SEQ ID NO:48)sequence) was as follows:

```
                                           (SEQ ID NO: 1028)
HHHHHHKSSNEATNITPKHNMKAFLDELKAENIKKFLYNFTQIPHLAGTE

QNFQLAKQIQSQWKEFGLDSVELAHYDVLLSYPNKTHPNYISIINEDGNE

IFNTSLFEPPPPGYENVSDIVPPFSAFSPQGMPEGDLVYVNYARTEDFFK

LERDMKINCSGKIVIARYGKVFRGNKVKNAQLAGAKGVILYSDPADYFAP

GVKSYPDGWNLPGGGVQRGNILNLNGAGDPLTPGYPANEYAYRRGIAEAV

GLPSIPVHPIGYYDAQKLLEKMGGSAPPDSSWRGSLKVPYNVGPGFTGNF

STQKVKMHIHSTNEVTRIYNVIGTLRGAVEPDRYVILGGHRDSWVFGGID

PQSGAAVVHEIVRSFGTLKKEGWRPRRTILFASWDAEEFGLLGSTEWAEE

NSRLLQERGVAYINADSSIEGNYTLRVDCTPLMYSLVHNLTKELKSPDEG

FEGKSLYESWTKKSPSPEFSGMPRISKLGSGNDFEVFFQRLGIASGRARY

TKNWETNKFSGYPLYHSVYETYELVEKFYDPMFKYHLTVAQVRGGMVFEL

ANSIVLPFDCRDYAVVLRKYADKIYSISMKHPQEMKTYSVSFDSLFSAVK

NFTEIASKFSERLQDFDKSNPIVLRMMNDQLMFLERAFIDPLGLPDRPFY

RHVIYAPSSHNKYAGESFPGIYDALFDIESKVDPSKAWGEVKRQIYVAAF

TVQAAAETLSEVA
```

Multiple VHH clones were identified, including those having the following amino acid sequences:

```
>P01C01R3
                                           (SEQ ID NO: 1029)
QVQLVESGGGLVQAGGSLRLSCAASGRTVNSYAMGWFRQAPGKEREFVAS

QSWMGAITYDADYADSVKGRFTISRDNAKNTLYLQMNSLKPEDTAVYRCA

ASRQARPGLHVREYDVWGQGTQVTVSSGPGGQHHHHHH

>P01H01R3
                                           (SEQ ID NO: 1030)
EVQLVESGGGLVQPGGSLRLSCVASVSSFSTNDMGWYRQAPGKQRELVAG

ITVGGNTFYAGSVKGRFTISRDNGKNTMYLQMNSLKPEDTAVYFCNVGAK

YRKPEWYSGEYWGQGTQVTVSSGPGGQHHHHHH

>P01G03R3
                                           (SEQ ID NO: 1031)
EVLVESGGGLVQAGGSLRLSCVVSGIAFSPYHMAWYRQAPGKQHEWVAVI

TTGGTTAYNETVEGRFSISRDNARSTVYLQMNSLKPEDTAVYYCNIYGLS

LKWGQGTQVTVSSGPGGQHHHHHH

>P01E02R3
                                           (SEQ ID NO: 1032)
EVLVESGGGLVQAGGSLKLSCVANGPTFSTYAMAWFRQAPGKEHEFVAAI

TGDGDTTNNADSVKGRFTISRDNAKNRVYLQLNSLKPEDTAAYYCAAGVH

HTYTIPRLWLYWGQGTQVTVSSGPGGQHHHHHH

>CB01A01R3
                                           (SEQ ID NO: 1033)
EVLVESGGGLVQAGGSLRISCTASERSVSTYTKGWFRQAPGKERHLVAAI

SYNGDTTYYSDSVKGRFTISRDNVKNTVNLQMNSLKPEDTAVYFCAARGS

SWLYGTWDDYHYWGQGTQVTVSSGPGGQHHHHHH

>CB01B02R3
                                           (SEQ ID NO: 1034)
QVQLVESGGGLVQAGDSLRLSCVTSGRTFDVYAMGWFRQAPGKERELVAA

INWSGSNKFHADSVKGRFTISRDNAWKTLSLQMNSLKPEDTAVYFCAAST

RLYGTTWYEFNDSDYWGQGTQVTVSSGPGGQHHHHHH

>CB01H01R3
                                           (SEQ ID NO: 1035)
EVLVESGGGSVQAGGSLSLSCVASGRTFGIYVMGWFRQAPGKEREFVAAI

SWSGSNRLVSDSVKGRFTISRENAKNTIYLQMNGLKPEDTANYFCAASNR

LYGRTWYDFNESDYWGQGTQVTVSSGPGGQHHHHHH
```

Example 2. Humanization of VHH Antibodies

Before humanization, a screen was performed by selecting 7 VHH sequences and testing them together with CD3.23 TCEs to screen for binding and function. Based on this screen, two different leads from Example 1 PSMA.2 (also referred to herein as CB01H01 R3 and used in a uTCE (without the C-terminal GPGGQHHHHHH (SEQ ID NO:9178) portion of the sequence shown above) together with CD3.23) and PSMA.3 (also referred to herein as CB01B02R3 and used in a uTCE (without the C-terminal GPGGQHHHHHH (SEQ ID NO:9178) portion of the sequence shown above) together with CD3.23) were selected for humanization. The humanized sequences described herein are expected to retain canonical structure of the CDR-loops.

| SEQ ID NO: | AMINO ACID SEQUENCE |
|---|---|
| 1036 | LTGPATSGSETPGTEVQLVESGGGLVQAGGSLRISCTASERS VSTYTKGWFRQAPGKERHLVAAISYNGDTTYYSDSVKGRFTI SRDNVKNTVNLQMNSLKPEDTAVYFCAARGSSWLYGTWDDYH YWGQGTQVTVSSGGGGSGGGSELVVTQEPSLTVSPGGTVTLT CRSSNGAVTSSNYANWVQQKPGQAPRGLIGGTNKRAPGTPAR FSGSLLGGKAALTLSGVQPEDEAVYYCALWYPNLWVFGGGTK LTVLGATPPETGAETESPGETTGGSAESEPPGEGEVQLLESG GGIVQPGGSLKLSCAASGFTFNTYAMNWVRQAPGKGLEWVAR IRSKYNNYATYYADSVKDRFTISRDDSKNTVYLQMNNLKTED TAVYYCVRHENFGNSYVSWFAHWGQGTLVTVSSGTAEAASAS GEAGRSANHTPAG |
| 1037 | LTGPATSGSETPGTQVQLVESGGGLVQAGGSLRLSCAASGRT VNSYAMGWFRQAPGKEREFVASQSWMGAITYDADYADSVKGR FTISRDNAKNTLYLQMNSLKPEDTAVYRCAASRQARPGLHVR EYDVWGQGTQVTVSSGGGGSGGGSELVVTQEPSLTVSPGGTV TLTCRSSNGAVTSSNYANWVQQKPGQAPRGLIGGTNKRAPGT PARFSGSLLGGKAALTLSGVQPEDEAVYYCALWYPNLWVFGG GTKLTVLGATPPETGAETESPGETTGGSAESEPPGEGEVQLL ESGGGIVQPGGSLKLSCAASGFTFNTYAMNWVRQAPGKGLEW VARIRSKYNNYATYYADSVKDRFTISRDDSKNTVYLQMNNLK TEDTAVYYCVRHENFGNSYVSWFAHWGQGTLVTVSSGTAEAA SASGEAGRSANHTPAG |
| 1038* | LTGPATSGSETPGTEVQLVESGGGSVQAGGSLSLSCVASGRT FGIYVMGWFRQAPGKEREFVAAISWSGSNRLVSDSVKGRFTI SRENAKNTIYLQMNGLKPEDTANYFCAASNRLYGRTWYDFNE SDYWGQGTQVTVSSGGGGSGGGSELVVTQEPSLTVSPGGTVT LTCRSSNGAVTSSNYANWVQQKPGQAPRGLIGGTNKRAPGTP ARFSGSLLGGKAALTLSGVQPEDEAVYYCALWYPNLWVFGGG TKLTVLGATPPETGAETESPGETTGGSAESEPPGEGEVQLLE SGGGIVQPGGSLKLSCAASGFTFNTYAMNWVRQAPGKGLEWV ARIRSKYNNYATYYADSVKDRFTISRDDSKNTVYLQMNNLKT EDTAVYYCVRHENFGNSYVSWFAHWGQGTLVTVSSGTAEAAS ASGEAGRSANHTPAG |
| 1039 | LTGPATSGSETPGTQVQLVESGGGLVQAGDSLRLSCVTSGRT FDVYAMGWFRQAPGKERELVAAINWSGSNKFHADSVKGRFTI SRDNAWKTLSLQMNSLKPEDTAVYFCAASTRLYGTTWYEFND SDYWGQGTQVTVSSGGGGSGGGSELVVTQEPSLTVSPGGTVT LTCRSSNGAVTSSNYANWVQQKPGQAPRGLIGGTNKRAPGTP ARFSGSLLGGKAALTLSGVQPEDEAVYYCALWYPNLWVFGGG TKLTVLGATPPETGAETESPGETTGGSAESEPPGEGEVQLLE SGGGIVQPGGSLKLSCAASGFTFNTYAMNWVRQAPGKGLEWV ARIRSKYNNYATYYADSVKDRFTISRDDSKNTVYLQMNNLKT EDTAVYYCVRHENFGNSYVSWFAHWGQGTLVTVSSGTAEAAS ASGEAGRSANHTPAG |
| 1040 | LTGPATSGSETPGTEVQLVESGGGLVQPGGSLRLSCVASVSS FSTNDMGWYRQAPGKQRELVAGITVGGNTFYAGSVKGRFTIS RDNGKNTMYLQMNSLKPEDTAVYFCNVGAKYRKPEWYSGEYW GQGTQVTVSSGGGGSGGGSELVVTQEPSLTVSPGGTVTLTCR SSNGAVTSSNYANWVQQKPGQAPRGLIGGTNKRAPGTPARFS GSLLGGKAALTLSGVQPEDEAVYYCALWYPNLWVFGGGTKLT VLGATPPETGAETESPGETTGGSAESEPPGEGEVQLLESGGG IVQPGGSLKLSCAASGFTFNTYAMNWVRQAPGKGLEWVARIR SKYNNYATYYADSVKDRFTISRDDSKNTVYLQMNNLKTEDTA VYYCVRHENFGNSYVSWFAHWGQGTLVTVSSGTAEAASASGE AGRSANHTPAG |
| 1041 | LTGPATSGSETPGTEVQLVESGGGLVQAGGSLKLSCVANGPT FSTYAMAWFRQAPGKEHEFVAAITGDGDTTNNADSVKGRFTI SRDNAKNRVYLQLNSLKPEDTAAYYCAAGVHHTYTIPRLWLY WGQGTQVTVSSGGGGSGGGSELVVTQEPSLTVSPGGTVTLTC RSSNGAVTSSNYANWVQQKPGQAPRGLIGGTNKRAPGTPARF SGSLLGGKAALTLSGVQPEDEAVYYCALWYPNLWVFGGGTKL TVLGATPPETGAETESPGETTGGSAESEPPGEGEVQLLESGG GIVQPGGSLKLSCAASGFTFNTYAMNWVRQAPGKGLEWVARI RSKYNNYATYYADSVKDRFTISRDDSKNTVYLQMNNLKTEDT AVYYCVRHENFGNSYVSWFAHWGQGTLVTVSSGTAEAASASG EAGRSANHTPAG |
| 1042 | LTGPATSGSETPGTEVQLVESGGGLVQAGGSLRLSCVVSGIA FSPYHMAWYRQAPGKQHEWVAVITTGGTTAYNETVEGRFSIS RDNARSTVYLQMNSLKPEDTAVYYCNIYGLSLKWGQGTQVTV SSGGGGSGGGSELVVTQEPSLTVSPGGTVTLTCRSSNGAVTS SNYANWVQQKPGQAPRGLIGGTNKRAPGTPARFSGSLLGGKA ALTLSGVQPEDEAVYYCALWYPNLWVFGGGTKLTVLGATPPE TGAETESPGETTGGSAESEPPGEGEVQLLESGGGIVQPGGSL KLSCAASGFTFNTYAMNWVRQAPGKGLEWVARIRSKYNNYAT YYADSVKDRFTISRDDSKNTVYLQMNNLKTEDTAVYYCVRHE NFGNSYVSWFAHWGQGTLVTVSSGTAEAASASGEAGRSANHT PAG |

*This is the uTCE sequence from AC2591 (i.e., the unmasked TCE of AC2591).

27 humanized variants of PSMA.2 and 31 humanized variants of PSMA.3 were designed. Table 9a lists the variants of PSMA.2 as VHH1 through VHH27. Table 9b lists the variants of PSMA.3 as VHH1 through VHH31.

Figure 2A:
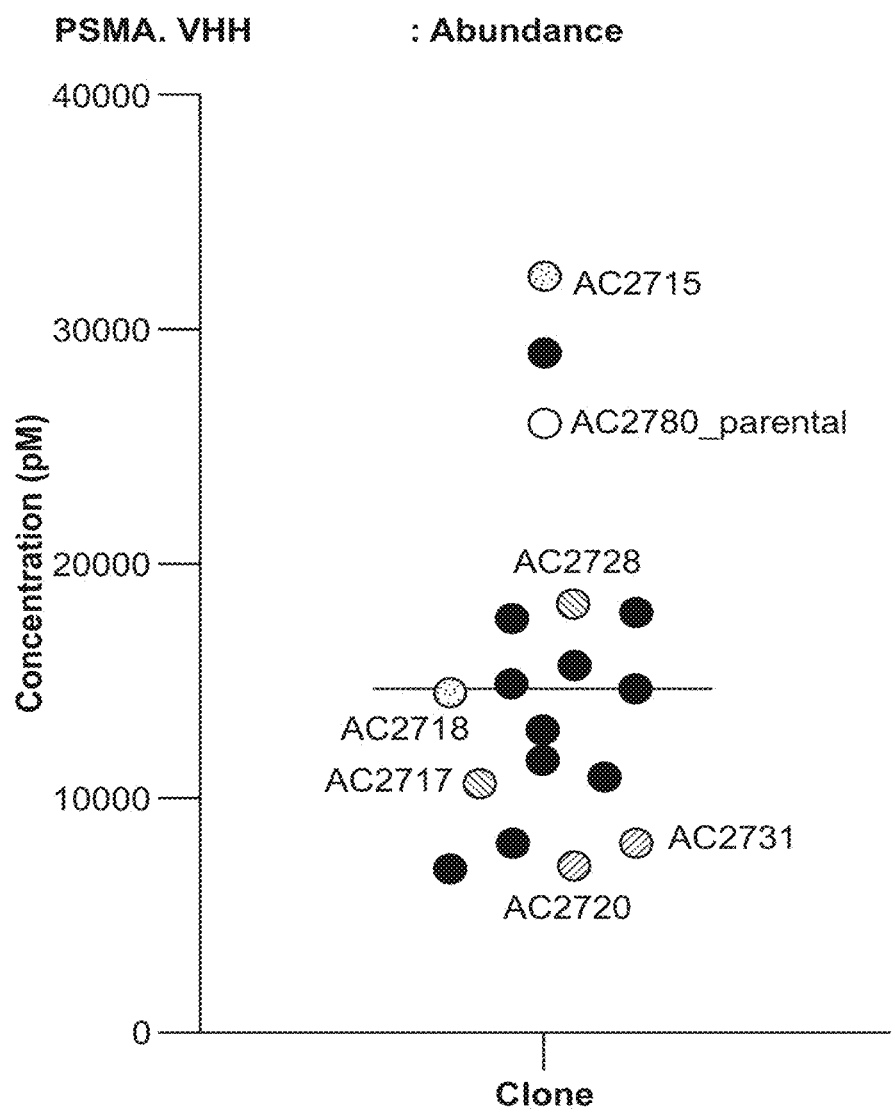
FIG. 2A-FIG. 2D depict biophysical characterization data of PMSA.2 variant antibodies.
Figure 2B:
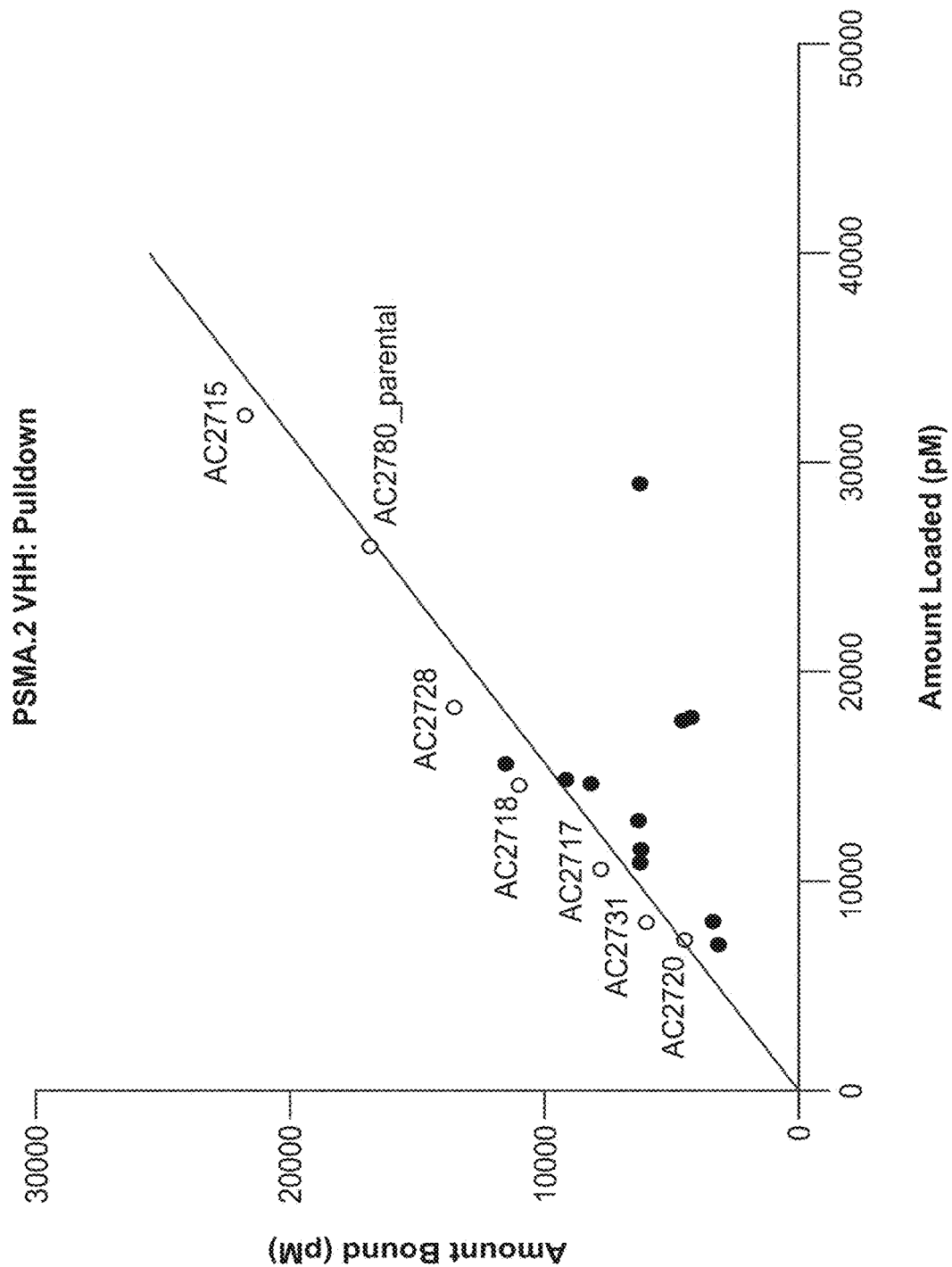
Figure 2C:
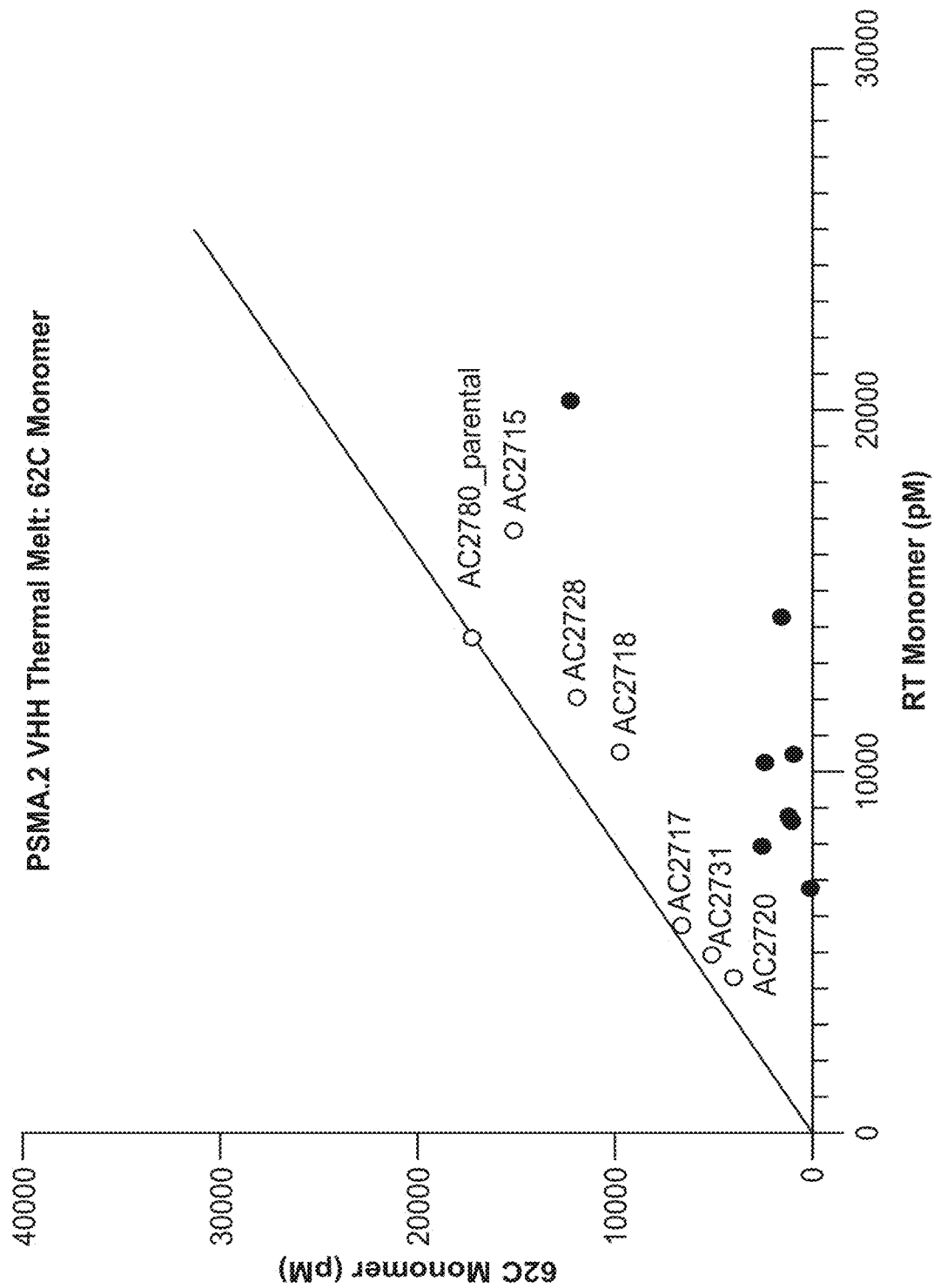
Figure 2D:
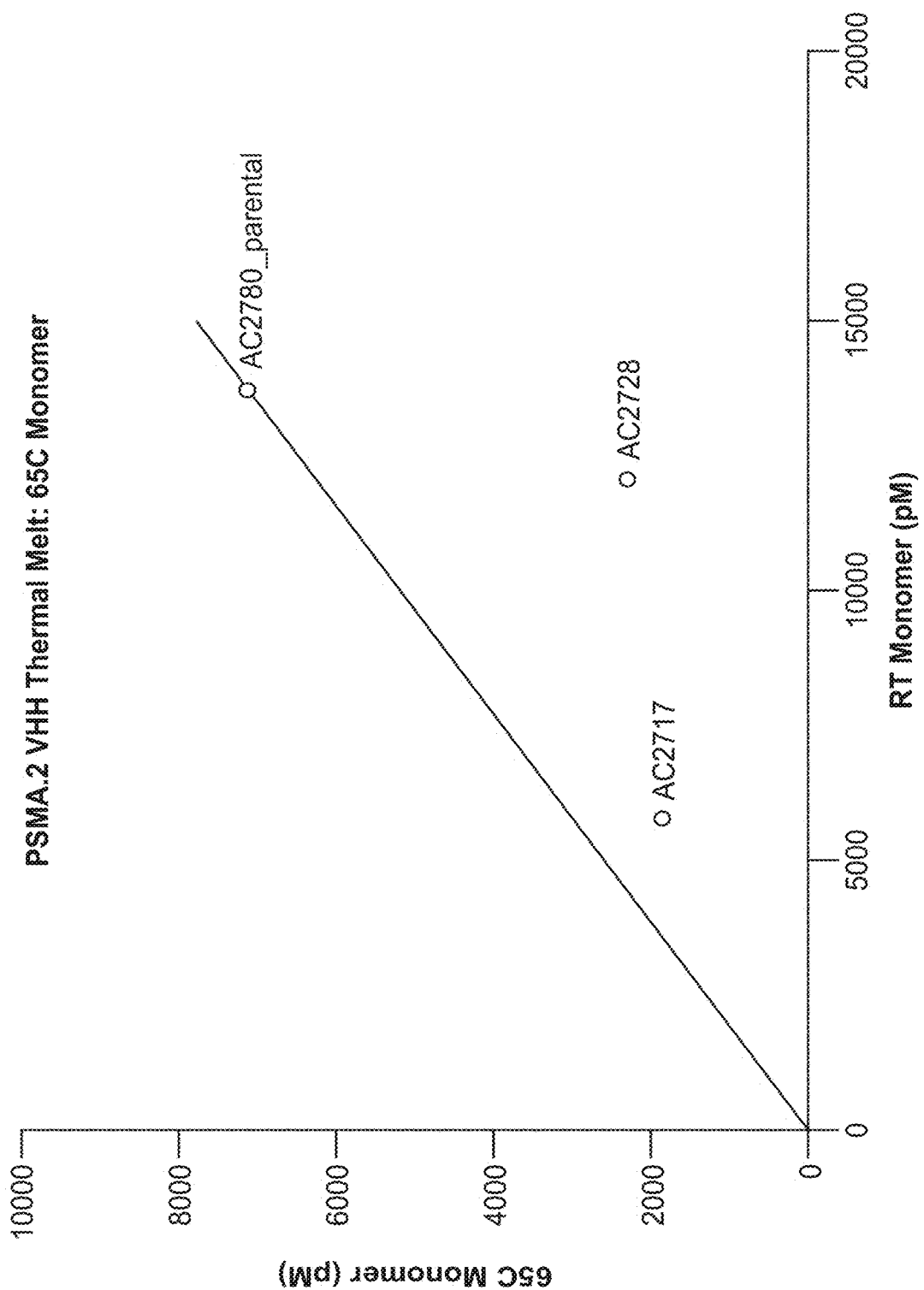

As shown in FIG. 2A-FIG. 2D, several biophysical properties of the PSMA.2 variants were tested. Several clones exhibited binding similar or equivalent to the parental clone (FIG. 2B; clones with weaker binding are shown with black dots). Several clones exhibited equivalent thermal stability at 60° C. and 62° C. compared to parental clone (FIG. 2C; close with less stability shown with black dots). uTCEs from clones AC2717 and AC2728 (i.e., the unmasked TCEs of AC2717 and AC2728) survived at 65° C. (FIG. 2E). AC2715 had the highest abundance (FIG. 2A). Based on these properties, AC2728, AC2717 and AC2715 were selected as top humanized leads from the PSMA.2 pool.

Figure 3A:
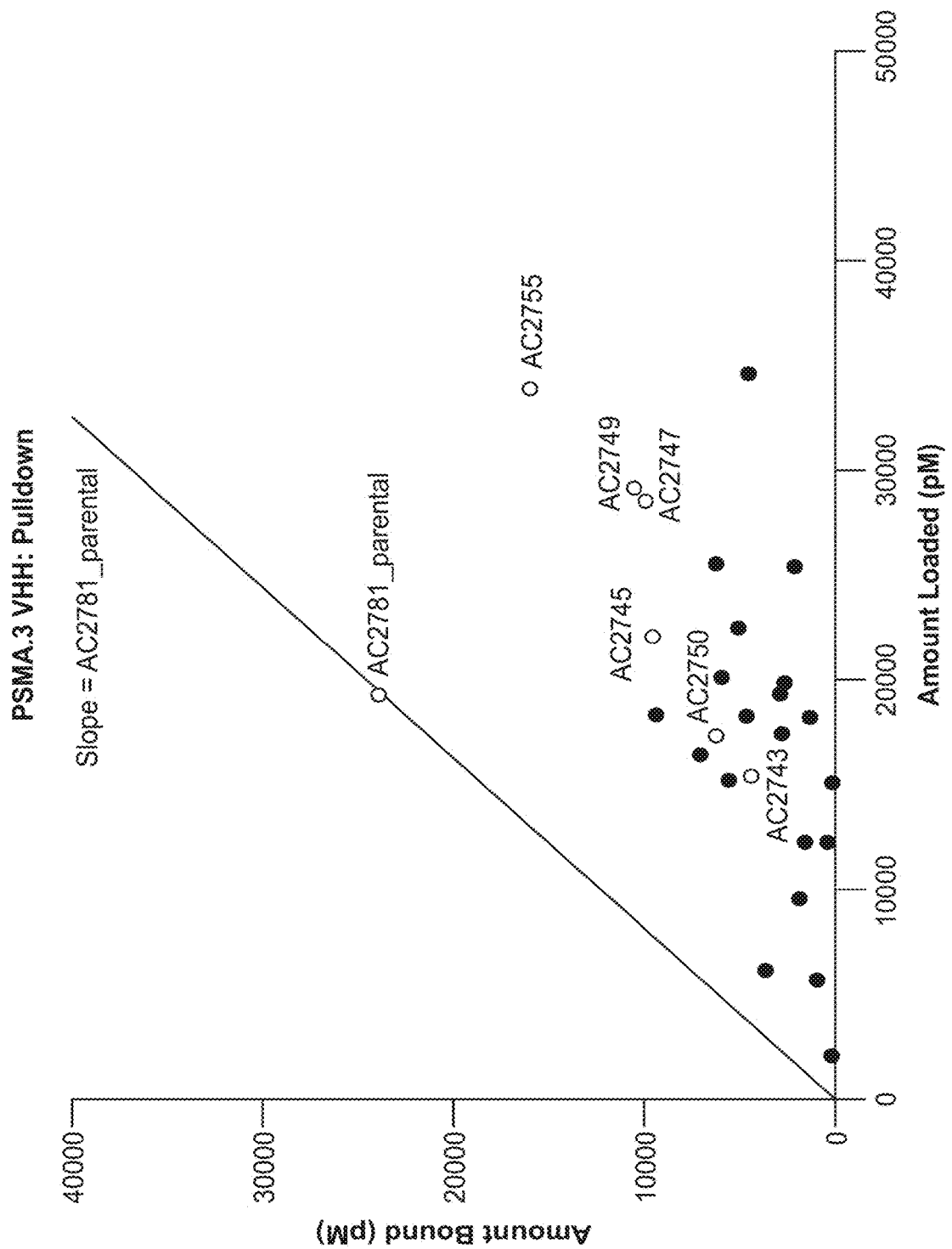
Figure 3B:
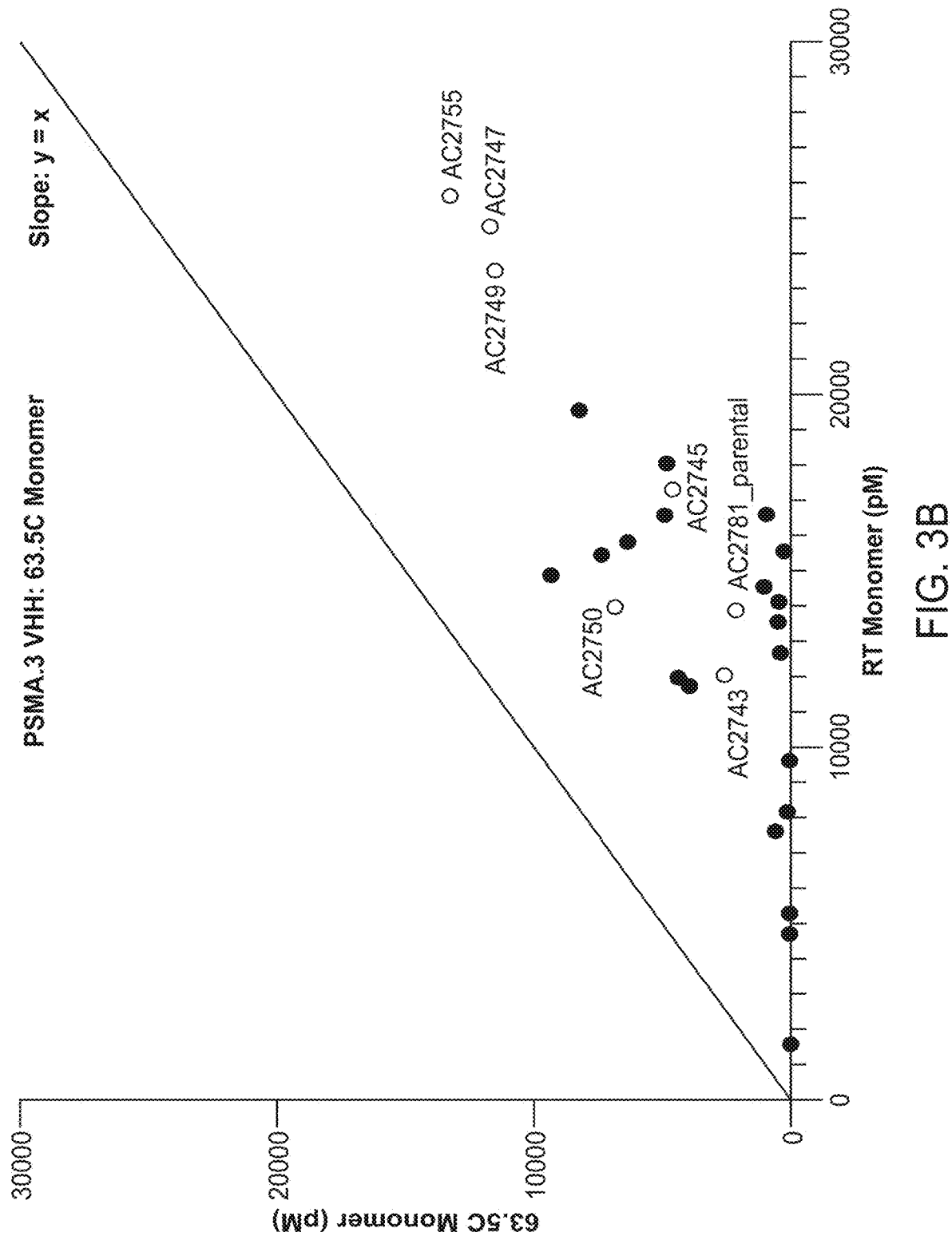

As shown in FIG. 3A-FIG. 3C, several biophysical properties of the PSMA.3 variants were tested. uTCEs from clones AC2755 and AC2750 exhibited above average binding and were the most thermally stable clones.

Of these humanized variants, two (PSMA.5 (also known as VHH3 and used in the uTCE of clone AC2717 together with CD3.23) and PSMA.6 (also known as VHH14 and used in the uTCE of clone AC2728 together with CD3.23)) showed slightly reduced but comparable binding affinity and comparable stability relative to PSMA.2.

For the study of bispecific antibodies comprising variants of PSMA.2 and PSMA.3, each variant was linked to CD3.23 to form the bispecific antibody.

TABLE 9a

Humanized variants of PSMA.2

| VHH | uTCE Clone # that the VHH was used in together with CD3.23 | Sequence |
|---|---|---|
| VHH1 | uTCE of AC2715 | EVLVESGGGLVQPGGSLRLSCAASGRTFGIYVMGWVRQAPGKEREFVSAISWSGSNRLVSDSVKGRFTISRDNSKNTLYLQMNSLRAEDTAVYYCAASNRLYGRTWYDFNESDYWGQGTQVTVSS (SEQ ID NO: 9179) |
| VHH2 | Utce of AC2716 | EVQLVESGGGLVQPGGSLRLSCAASGRTFGIYVMGWVRQAPGKEREFVSAISWSGSNRLVSDSVKGRFTISRDNAKNSLYLQMNSLRAEDTAVYYCAASNRLYGRTWYDFNESDYWGQGTQVTVSS (SEQ ID NO: 9180) |
| VHH3 | uTCE of AC2717 | QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9181) |
| VHH4 | uTCE of AC2718 | EVQLVESGGGVVQPGRSLRLSCAASGRTFGIYVMGWVRQAPGKEREFVAAISWSGSNRLVSDSVKGRFTISRDNSKNTLYLQMNSLRAEDTAVYFCAASNRLYGRTWYDFNESDYWGQGTLVTVSS (SEQ ID NO: 9182) |
| VHH5 | uTCE of AC2719 | QVQLVESGGGVVQPGRSLRLSCAASGRTFGIYVMGWVRQAPGKEREFVAAISWSGSNRLVSDSVKGRFTISRDNSKNTLYLQMNSLRAEGTAVYFCAASNRLYGRTWYDFNESDYWGQGTMVTVSS (SEQ ID NO: 9183) |
| VHH6 | uTCE of AC2720 | QVQLVESGGGVVQPGRSLRLSCAASGRTFGIYVMGWVRQAPGKEREFVAAISWSGSNRLVSDSVKGRFTISRDNSKNTLYLQMNSLRAEDTAVYFCAASNRLYGRTWYDFNESDYWGQGTTVTVSS (SEQ ID NO: 9184) |
| VHH7 | uTCE of AC2721 | EVLVESGGGLVQPGGSLRLSCAVSGRTFGIYVMGWVRQAPGKEREFVSAISWSGSNRLVSDSVKGRFTISRDNSKNTLYLQMNSLRAEDTASYFCAASNRLYGRTWYDFNESDYWGQGTLVTVSS (SEQ ID NO: 9185) |
| VHH8 | Utce of AC2722 | EVQLVESGGGVVQPGRSLRISCAASGRTFGIYVMAWFRQAPGKEREFVAVISWSGSNKLVTDSVKGRFTISRDNSKNTVYLQMNSLRPEDTANYFCAASNRLYGRTWYDFNESDYWGQGTLVTVSS (SEQ ID NO: 9186) |
| VHH9 | uTCE of AC2723 | QVQLVESGGGVVQPGRSLRLSCAASGRTFGIYVMAWVRQAPGKEREFVAAISWSGSNRLVSDSVKGRFTISRDNSKNTLYLQMNSLRPEDTAVYFCAASNRLYGRTWYDFNESDYWGQGTLVTVSS (SEQ ID NO: 9187) |
| VHH10 | uTCE of AC2724 | QVQLVESGGGVVQPGRSLRLSCAASGRTFGIYVMAWVRQAPGKEREFVAAISWSGSNRLVSDSVKGRFTISRDNSKNTLYLQMNSLRPEDTAVYFCAASNRLYGRTWYDFNESDYWGQGTLVTVSS (SEQ ID NO: 9187) |
| VHH11 | Utce of AC2725 | QVQLVESGGGVVQAGGSLSLSCVASGRTFGIYVMAWFRQAPGKEREFLTVISWSGSNKLVTDSVKGRFTISRDNSKNTLYLQMNSLRAEDTGLYFCAASNRLYGRTWYDFNESDYWGQGTLLTVSS (SEQ ID NO: 9188) |
| VHH12 | uTCE of AC2726 | EVKLVESGGGLVQPGSLRLSCVASGRTFGIYVMGWVRQVPGKSRQFVSAISWSGSNRLVSDSVKGRFTISRDNAKNSLFLQMNSLRPEDTALYFCAASNRLYGRTWYDFNESDYWGQGTQVTVSS (SEQ ID NO: 9189) |
| VHH13 | uTCE of AC2727 | EVQLLESGGGLVQPGGSLRLSCAASGRTFGIYVMGWVRQAPGKEREFVSAISWSGSNRLVSDSVKGRFTISRDNSKNTLYLQMNSLRAEDTAIYFCAASNRLYGRTWYDFNESDYWGQGTLVTVSS (SEQ ID NO: 9190) |
| VHH14 | uTCE of AC2728 | EVQLVESGGGVVQPGRSLRLSCAASGRTFGIYVMGWVRQAPGKEREFVAAISWSGSNRLVSDSVKGRFTISRDNSKNTLYLQMNSLRAEDTAVYFCAASNRLYGRTWYDFNESDYWGQGTTVTVSS (SEQ ID NO: 9191) |

TABLE 9a-continued

| | Humanized variants of PSMA.2 | |
|---|---|---|
| VHH | uTCE Clone # that the VHH was used in together with CD3.23 | Sequence |
| VHH15 | uTCE of AC2729 | EVQLVESGGGSVQPGGSLRLSCAASGRTFGIYVMAWFR QAPGKEREFVAVISWSGSNRLVTDSVKGRFTISRENSKN TLYLQMNSLRAEDTANYFCAASNRLYGRTWYDFNESDY WGQGTQVTVSS (SEQ ID NO: 9192) |
| VHH16 | uTCE of AC2730 | EVQLVESGGGLVQPGGSLRLSCAASGRTFGIYVMGWFR QAPGKEREFVSVISWSGSNRLVSDSVKGRFTISRENAKN SLYLQMNSLRAEDTANYFCAASNRLYGRTWYDFNESDY WGQGTQVTVSS (SEQ ID NO: 9193) |
| VHH17 | uTCE of AC2731 | EVQLVESGGGLVQPGGSLRLSCAASGRTFGIYVMAWFR QAPGKEREFVSAISWSGSNRLVSDSVKGRFTISRDNSKN TLYLQMNSLRAEDTAVYFCAASNRLYGRTWYDFNESDY WGQGTQVTVSS (SEQ ID NO: 9194) |
| VHH18 | uTCE of AC2732 | EVQLVESGGGLVQPGGSLRLSCAVSGRTFGIYVMGWVR QAPGKEREFVSAITWSGTNRLVSDSVKGRFTISRDNSKN TLYLQMNSLRAEDTASYFCAASNRLYGRTWYDFNESDY WGQGTLVTVSS (SEQ ID NO: 9195) |
| VHH19 | uTCE of AC2733 | EVQLVESGGGLVQPGGSLRLSCAVSGRTFGIYVLGWFR QAPGKEREFVSAISWSGSNRLVSDSVKGRFTISRDNSKN TLYLQMNSLRAEDTASYFCAGSNRLYGRTWYDFNESDY WGQGTQVTVSS (SEQ ID NO: 9196) |
| VHH20 | uTCE of AC2734 | EVQLVESGGGLVQPGGSLRLSCAVSGRTFGIYVLGWFR QAPGKEREFVSAITWSGTNRLVSDSVKGRFTISRDNSKN TLYLQMNSLRAEDTASYFCAGSNRLYGRTWYDFNESDY WGQGTQVTVSS (SEQ ID NO: 9197) |
| VHH21 | uTCE of AC2735 | EVQLVESGGGLVQPGGSLRLSCAVSGRTFGIYVLGWFR QAPGKEREFVSAITWSGTNRLVSDSVKGRFTISRDNSKN TLYLQMNSLRAEDTASYFCGASNRLYGRTWYDFNESDY WGQGTQVTVSS (SEQ ID NO: 9198) |
| VHH22 | uTCE of AC2736 | EVQLLESGGGLVQPGGSLRLSCAASGRTFGIYVLGWFR QAPGKEREFVSAISYSGSNRLVSDSVKGRFTISRDNSKN TLYLQMNSLRAEDTAIYFCGASNRLYGRTWYDFNESDY WGQGTQVTVSS (SEQ ID NO: 9199) |
| VHH23 | uTCE of AC2737 | EVQLLESGGGLVQPGGSLRLSCAASGRTFGIYVMGWFR QAPGKEREFVSAISWSGSDRLVSDSVKGRFTISRDNSKN TLYLQMNSLRAEDTAIYFCAASNRLYGRTWYDFNESDY WGQGTLVTVSS (SEQ ID NO: 9200) |
| VHH24 | uTCE of AC2738 | EVQLLESGGGLVQPGGSLRLSCAASGRTFGIYVMGWVR QAPGKEREFVSAITWSGTNRLVSDSVKGRFTISRDNSKN TLYLQMNSLRAEDTAIYFCGASNRLYGRTWYDFNESDY WGQGTLVTVSS (SEQ ID NO: 9201) |
| VHH25 | uTCE of AC2739 | EVQLVESGGGSVQPGGSLRLSCAASGRTFGIYVMAWFR QAPGKEREFVAVISWSGTNRLVTDSVKGRFTISRENSKN TLYLQMNSLRAEDTANYFCAGSNRLYGRTWYDFNESDY WGQGTQVTVSS (SEQ ID NO: 9202) |
| VHH26 | uTCE of | EVQLVESGGGSVQPGGSLRLSCAASGRTFGIYVMAWFR QAPGKEREFVAVISWSGTNRLVTDSVKGRFTISRENSKN TLYLQMNSLRAEDTANYFCGASNRLYGRTWYDFNESDY WGQGTQVTVSS (SEQ ID NO: 9203) |
| VHH27 | uTCE of AC2741 | EVQLVESGGGSVQPGGSLRLSCAASGRTFGIYVMAWFR QAPGKEREFVAVITWSGTNRLVTDSVKGRFTISRENSKN TLYLQMNSLRAEDTANYFCGASNRLYGRTWYDFNESDY WGQGTQVTVSS (SEQ ID NO: 9204) |

TABLE 9b

| | Humanized variants of PSMA.3 | |
|---|---|---|
| VHH | uTCE Clone # the VHH was used in Together with CD3.23 | Sequence |
| VHH28 | uTCE of AC2742 | QVQLVESGGGVVQPGRSLRLSCAASGRTFDVYAMGWF RQAPGKERELVAAINWSGSNKFHADSVKGRFTISRDNS KNTLYLQMNSLRAEDTAVYFCAASTRLYGTTWYEFNDS DYWGQGTQVTVSS (SEQ ID NO: 9205) |
| VHH29 | uTCE of AC2743 | EVQLLESGGGLVQPGGSLRLSCAASGRTFDVYAMGWF RQAPGKERELVSAINWSGSNKFHADSVKGRFTISRDNS KNTLYLQMNSLRAEDTAVYFCAASTRLYGTTWYEFNDS DYWGQGTQVTVSS (SEQ ID NO: 9206) |
| VHH30 | uTCE of AC2744 | EVLVESGGGLVQPGGSLRLSCAASGRTFDVYAMSWV RQAPGKERELVAAINWSGSNKFHADSVKGRFTISRDNA KNSLYLQMNSLRAEDTAVYFCAASTRLYGTTWYEFNDS DYWGQGTQVTVSS (SEQ ID NO: 9207) |
| VHH31 | uTCE of AC2745 | QVQLVESGGGLVQPGGSLRLSCSASGRTFDVYAMGWV RQAPGKERELVSAINWSGSNKFHADSVKGRFTISRDNS KNTLYLQMNSLRAEDTAVYFCAASTRLYGTTWYEFNDS DYWGQGTQVTVSS (SEQ ID NO: 9208) |
| VHH32 | uTCE of AC2746 | QVQLEESGGGVVQPGRSLRLSCVVSGRTFDVYAMGW VRQAPGKERELVAAINWSGSNKFHADSVKGRFTISRDN SKNTLNLQMNSLRPEDTAVYFCAASTRLYGTTWYEFND SDYWGQGTQVTVSS (SEQ ID NO: 9209) |
| VHH33 | uTCE of AC2747 | QVQLVESGGGVVQPGRSLRLSCAASGRTFDVYAMAWF RQAPGKERELVAAINWSGSNKFHADSVKGRFTISRDNS KNTLFLQMNSLRPEDTAVYFCAASTRLYGTTWYEFNDS DYWGQGTQVTVSS (SEQ ID NO: 9210) |
| VHH34 | uTCE of AC2748 | QVQLVQSGGGVVQPGRSLRLSCAASGRTFDVYAMGW FRQAPGKERELVAAINWSGSNKFHADSVKGRFTISRDN SKNTLSLQMNSLRAEDTAVYFCAASTRLYGTTWYEFND SDYWGQGTQVTVSS (SEQ ID NO: 9211) |
| VHH35 | uTCE of AC2749 | QVQLVESGGGVVQPGRSLRLSCAASGRTFDVYAMGWF RQAPGKERELVAAINWSGSNKFHADSVKGRFTISRDNS RNTLYLQMNSLRAEDTAVYFCAASTRLYGTTWYEFNDS DYWGQGTQVTVSS (SEQ ID NO: 9212) |
| VHH36 | uTCE of AC2750 | QVQLVESGGGVVQPGRSLRLSCAASGRTFDVYAMGWF RQAPGKGRELVAAINWSGSNKFHADSVKGRFTISRDNS KNTLYLQMNSLRPEDTAVYFCAASTRLYGTTWYEFNDS DYWGQGTQVTVSS (SEQ ID NO: 9213) |
| VHH37 | uTCE of AC2751 | QVQLVESGGGVVQPGRSLRLSCAASGRTFDVYAMGWF RQAPGKERELVAAINWSGSNKFHADSVKGRFTISRDNS KKTLYLQMNSLRAEDTAVYFCAASTRLYGTTWYEFNDS DYWGQGTQVTVSS (SEQ ID NO: 9214) |
| VHH38 | uTCE of AC2752 | EVLVESGGGLVQPGGSLRLSCAASGRTFDVYAMGWF RQAPGKGRELVSAINWSGSNKFHADSVKGRFTISRDNS KNTLYLQMNSLRAEDTAVYFCAASTRLYGTTWYEFNDS DYWGQGTQVTVSS (SEQ ID NO: 9215) |
| VHH39 | uTCE of AC2753 | QVQLVESGGGVVQPGRSLRLSCAASGRTFDVYAMGWF RQAPGKERELVAAINWSGSNKFHADSVKGRFTISRDNS KNTLFLQMNSLRADDTAVYFCAASTRLYGTTWYEFNDS DYWGQGTQVTVSS (SEQ ID NO: 9216) |
| VHH40 | uTCE of AC2754 | QVQVIESGGGVVQSGKSLRLACTTSGRTFDVYAMGWF RQAPGKGRELVAAINWSGSNKFHADSVKGRFTISRDNS KNTLYLQMNSLRAEDTAVYFCAASTRLYGTTWYEFNDS DYWGQGTQVTVSS (SEQ ID NO: 9217) |

TABLE 9b-continued

Humanized variants of PSMA.3

| VHH | uTCE Clone # the VHH was used in Together with CD3.23 | Sequence |
|---|---|---|
| VHH41 | uTCE of AC2755 | QVQLVESGGGVVQPGRSLRLSCAASGRTFDVYAMGW VRQAPGKERELVAAINWSGSNKFHADSVKGRFTISRDN SKNTLYLQMNSLKTEDTAMYFCAASTRLYGTTWYEFND SDYWGQGTQVTVSS (SEQ ID NO: 9218) |
| VHH42 | uTCE of AC2756 | EVQLLESGGGLVQSGDSLRLSCATSGRTFDVYAMSWF RQAPGKERELVSAIDWSGSNKFHADSVKGRFTISRDNS WKTLYLQMNSLRPEDTAVYFCAASTRLYGTTWYEFNDS DYWGQGTQVTVSS (SEQ ID NO: 9219) |
| VHH43 | uTCE of AC2757 | QVQLVESGGGLVQPGRSLRLSCATSGFTFDVYAMGWF RQAPGKERELVSAINWGGSNKFHADSVKGRFTISRDNS WKTLYLQMNSLRAEDTAVYFCAASTRLYGTTWYEFNDS DYWGQGTQVTVSS (SEQ ID NO: 9220) |
| VHH44 | uTCE of AC2758 | QVQLVESGGGVVQPGDSLRLSCATSGRTFDVYAMGWF RQAPGKERELVAAINWAGSNKFHADSVKGRFTISRDNS KNTLSLQMNSLRAEDTAVYFCAASTRLYGTTWYEFNDS DYWGQGTQVTVSS (SEQ ID NO: 9221) |
| VHH45 | uTCE of AC2759 | QVQLVESGGGVVQPGDSLRLSCATSGRTFDVYAMSWF RQAPGKERELVAAINWAGSNKFHADSVKGRFTISRDNS KNTLSLQMNSLRPEDTAVYFCAASTRLYGTTWYEFNDS DYWGQGTQVTVSS (SEQ ID NO: 9222) |
| VHH46 | uTCE of AC2760 | QVQLVESGGGVVQPGDSLRLSCATSGRTFDVYAMAWF RQAPGKERELVAAINWAGSNKFHADSVKGRFTISRDNS KNTLSLQMNSLRPEDTAVYFCAASTRLYGTTWYEFNDS DYWGQGTQVTVSS (SEQ ID NO: 9223) |
| VHH47 | uTCE of AC2761 | QVQLVESGGGVVQPGDSLRLSCATSGRTFDVYAMAWF RQAPGKERELVAAINWGGSNKFHADSVKGRFTISRDNS KNTLSLQMNSLRPEDTAVYFCAASTRLYGTTWYEFNDS DYWGQGTQVTVSS (SEQ ID NO: 9224) |
| VHH48 | uTCE of AC2762 | EVQLLESGGGLVQSGDSLRLSCATSGRTFDVYAMSWF RQAPGKERELVSAINWSGSNKFHADSVKGRFTISRDNS WKTLYLQMNSLRPEDTAVYFCGATSRLYGTTWYEFND SDYWGQGTQVTVSS (SEQ ID NO: 9225) |
| VHH49 | uTCE of AC2763 | QVQLVESGGGLVQPGRSLRLSCATSGFTFDVYAMGWF RQAPGKERELVSAINWSGSNKFHADSVKGRFTISRDNA WKTLYLQMNSLRAEDTAVYFCAGSTRLYGTTWYEFND SDYWGQGTQVTVSS (SEQ ID NO: 9226) |
| VHH50 | uTCE of AC2764 | QVQLVESGGGVVQPGDSLRLSCATSGRTFDVYAMGWF RQAPGKERELVAAINWSGSNKFHADSVKGRFTISRDNS KNTLSLQMNSLRAEDTAVYFCGASTRLYGTTWYEFNDS DYWGQGTQVTVSS (SEQ ID NO: 9227) |
| VHH51 | uTCE of AC2765 | QVQLVESGGGVVQPGDSLRLSCATSGRTFDVYAMSWF RQAPGKERELVAAINWSGSNKFHADSVKGRFTISRDNS KNTLSLQMNSLRPEDTAVYFCAGSTRLYGTTWYEFNDS DYWGQGTQVTVSS (SEQ ID NO: 9228) |
| VHH52 | uTCE of AC2766 | QVQLVESGGGVVQPGDSLRLSCATSGRTFDVYAMAWF RQAPGKERELVAAINWSGSNKFHADSVKGRFTISRDNS KNTLSLQMNSLRPEDTAVYFCAGTTRLYGTTWYEFNDS DYWGQGTQVTVSS (SEQ ID NO: 9229) |
| VHH53 | uTCE of AC2767 | EVQLLESGGGLVQSGDSLRLSCATSGRTFDVYAMSWF RQAPGKERELVSAIDWSGSNKFHADSVKGRFTISRDNS WKTLYLQMNSLRPEDTAVYFCGATSRLYGTTWYEFND SDYWGQGTQVTVSS (SEQ ID NO: 9230) |
| VHH54 | uTCE of AC2768 | QVQLVESGGGLVQPGRSLRLSCATSGFTFDVYAMGWF RQAPGKERELVSAINWGGSNKFHADSVKGRFTISRDNA WKTLYLQMNSLRAEDTAVYFCAGSTRLYGTTWYEFND SDYWGQGTQVTVSS (SEQ ID NO: 9231) |

TABLE 9b-continued

Humanized variants of PSMA.3

| VHH | uTCE Clone # the VHH was used in Together with CD3.23 | Sequence |
|---|---|---|
| VHH55 | uTCE of AC2769 | QVQLVESGGGVVQPGDSLRLSCATSGRTFDVYAMGWF RQAPGKERELVAAINWAGSNKFHADSVKGRFTISRDNS KNTLSLQMNSLRAEDTAVYFCGASTRLYGTTWYEFNDS DYWGQGTQVTVSS (SEQ ID NO: 9232) |
| VHH56 | uTCE of AC2770 | QVQLVESGGGVVQPGDSLRLSCATSGRTFDVYAMSWF RQAPGKERELVAAINWAGSNKFHADSVKGRFTISRDNS KNTLSLQMNSLRPEDTAVYFCAGTSRLYGTTWYEFNDS DYWGQGTQVTVSS (SEQ ID NO: 9233) |
| VHH57 | uTCE of AC2771 | QVQLVESGGGVVQPGDSLRLSCATSGRTFDVYAMAWF RQAPGKERELVAAINWAGSNKFHADSVKGRFTISRDNS KNTLSLQMNSLRPEDTAVYFCAGTTRLYGTTWYEFNDS DYWGQGTQVTVSS (SEQ ID NO: 9234) |
| VHH58 | uTCE of AC2772 | QVQLVESGGGVVQPGDSLRLSCATSGRTFDVYALAWF RQAPGKERELVAAINWGGSNKFHADSVKGRFTISRDNS KNTLSLQMNSLRPEDTAVYFCAGTSRLYGTTWYEFNDS DYWGQGTQVTVSS (SEQ ID NO: 9235) |

Example 3. Removal of Putative T Cell Epitopes

Figure 4:
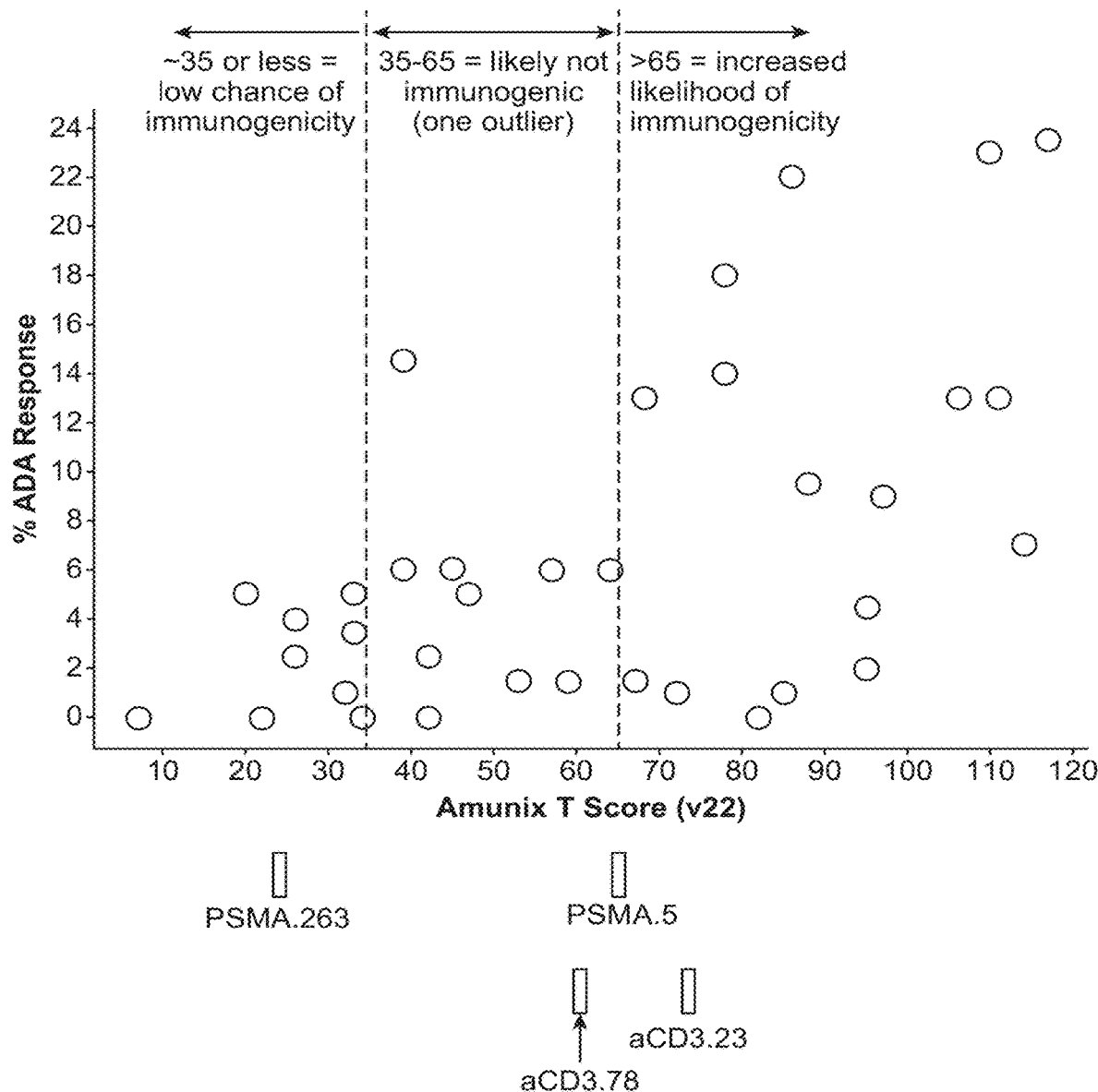
FIG. 4 depicts PTE scores of representative PSMA variants and CD3 variants. The graph shows molecules with known Antidrug Antibody (ADA) and their corresponding PTE score. The higher score indicates greater chance of having putative T cell epitopes.

PSMA.5 was used as the template for removal of PTE based on a proprietary computer prediction program. Three potential hot spots were identified in PSMA.5 that were labeled as Pep19, Pep26, and Pep33. A round of screening was performed by generating 102 point mutations (Pool 1). Mutations from Pool 1 were screened for binding and thermal stability. A pool (Pool 2) of combined mutations was generated from Pool 1 and comprised 40 clones. Each clone in Pool 2 had more than 2 mutations. Pool 2 was screened for binding and thermal stability. PSMA.263 from Pool 2 was selected as a template and combined with additional mutations from Pool 1 to make Pool 3. A total of 60 variants from Pool 3 were tested. PSMA.350 from Pool 3 was selected as the final VHH lead in AMX-500. FIG. 4 depicts PTE scores of representative PSMA variants and CD3 variants. The graph shows molecules with known Antidrug Antibody (ADA) and their corresponding PTE score. The higher score indicates greater chance of having putative T cell epitopes.

Figure 5:
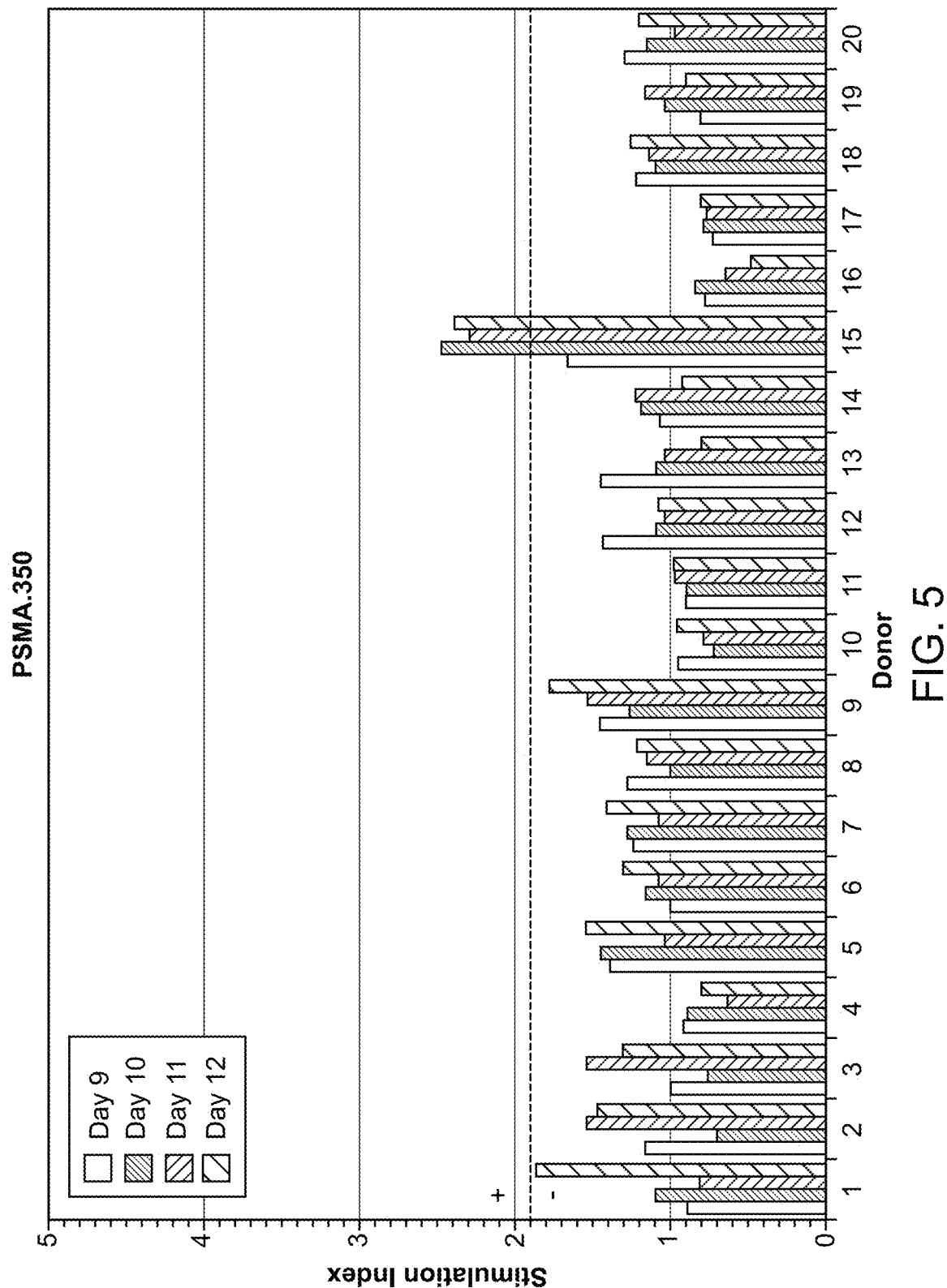
FIG. 5 depicts T cell proliferation in an EpiScreen™ DC: T cell immunogenicity assay. PSMA.350 and the positive control KLH were tested. For each donor date point, each bar from left to right represents Day 9, Day 10, Day 11, and Day 12.
Figure 5:
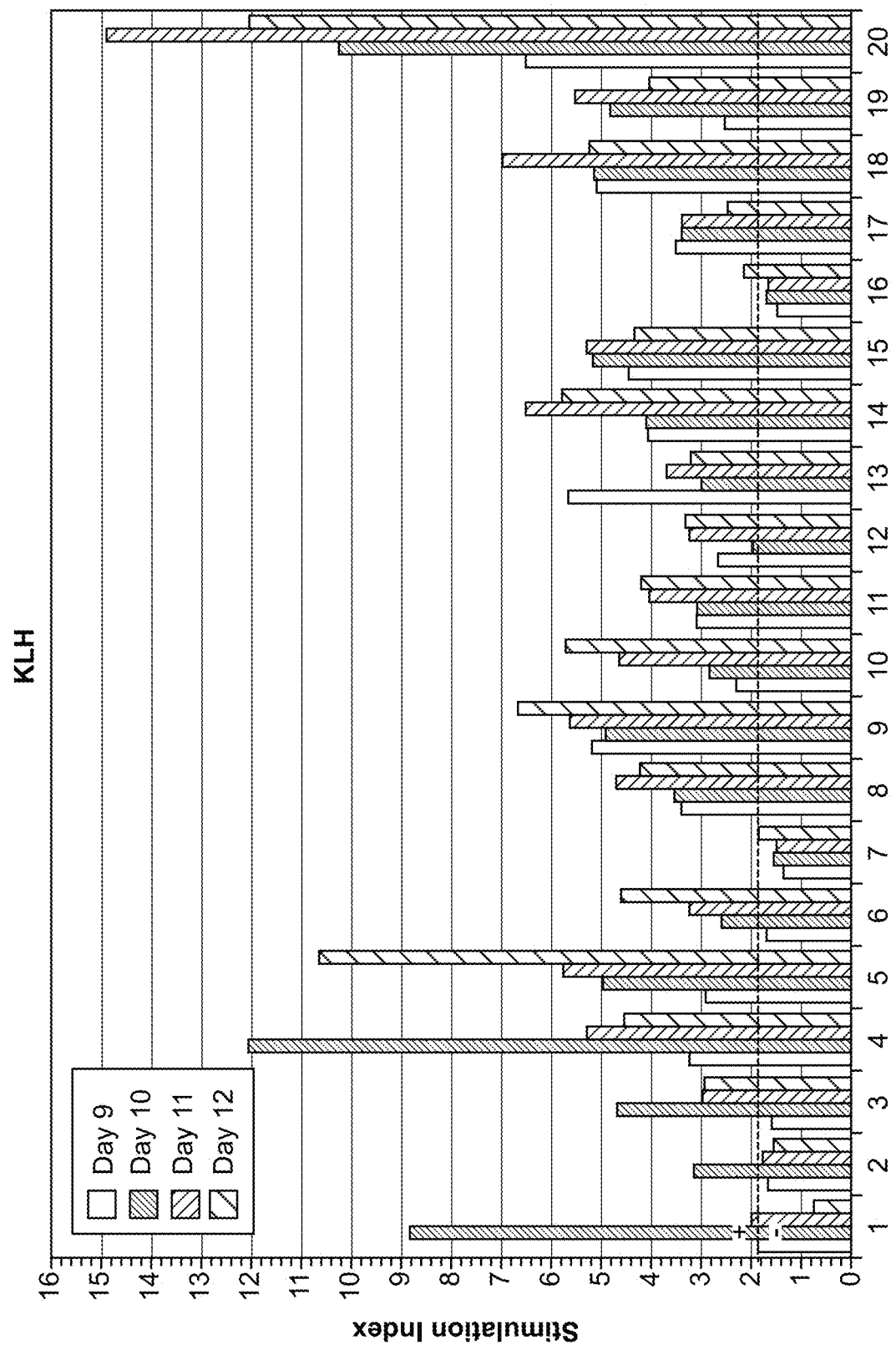

PSMA.350 was further tested for T cell immunogenicity in an EpiScreen™ DC:T cell immunogenicity assay. Briefly, PBMCs were extracted from 20 healthy donors. Monocyte-derived dendritic cells and CD4+ T cells were isolated. On Day 4 of culturing, test antigen was added to the culture. The neoantigen Keyhole limpet haemocyanin (KLH) was used as a positive control in a separate culture. CD4+ T cells were isolated on Day 5. T cell proliferation was monitored on Day 9, 10, 11, and 12. As shown in FIG. 5, PSMA.350 induced positive donor responses in only 5% of donor samples, while the KLH positive control induced a position response in 95% of samples.

Tables 10, 10b, and 10c provide the PSMA binding sequences for Pools 1, 2, and 3, respectively. The tables also provide the TOE clone numbers in which the PSMA binding sequences were used together with CD3.23.

TABLE 10a

| | | | Clone # the VHH was used in Together with CD3.23 |
|---|---|---|---|
| Mutation | PSMA domain | Sequence | |
| None | PSMA.5 | QVQLVESGGGVVQPGRSLRLSCAASGRTFGIYV FGWVRQAPGKEREFVAAISWSGSNRLVSDSVK GRFTISRDNSKNTLYLQMNSLRAEDTAVYYCAA SNRLYGRTWYDFNESDYWGQGTQVTVSS (SEQ ID NO: 9236) | AC2717 |
| Y32A | PSMA.41 | QVQLVESGGGVVQPGRSLRLSCAASGRTFGIYV MGWARQAPGKEREFVAAISWTGSNRYVSDSVK GRFTISRDNSKNTLYLQMNSLRAEDTAVYYCAA SNRTYGRTWYDFNESDYWGQGTQVTVSS (SEQ ID NO: 9237) | AC3251 |

PSMA VHH sequences from Pool 1

TABLE 10a-continued

PSMA VHH sequences from Pool 1

| Mutation | PSMA domain | Sequence | Clone # the VHH was used in Together with CD3.23 |
|---|---|---|---|
| Y32K | PSMA.42 | QVQLVESGGGVVQPGRSLRLSCAASGRTFGIKVMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9238) | AC3252 |
| V33A | PSMA.43 | QVQLVESGGGVVQPGRSLRLSCAASGRTFGIYAMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9239) | AC3253 |
| V33H | PSMA.44 | QVQLVESGGGVVQPGRSLRLSCAASGRTFGIYHMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9240) | AC3254 |
| V33P | PSMA.45 | QVQLVESGGGVVQPGRSLRLSCAASGRTFGIYPMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9241) | AC3255 |
| V33S | PSMA.46 | QVQLVESGGGVVQPGRSLRLSCAASGRTFGIYVMGWARQAPGKEREFVAAISWTGSNRYVSDSVKGRFTISRDNSKNTLYLQMNSLRAEDTAVYYCAASNRTYGRTWYDFNESDYWGQGTQVTVSS (SEQ ID NO: 9237) | AC3256 |
| V33W | PSMA.47 | QVQLVESGGGVVQPGRSLRLSCAASGRTFGIYWMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9242) | AC3257 |
| V33Y | PSMA.48 | QVQLVESGGGVVQPGRSLRLSCAASGRTFGIYYMGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9243) | AC3258 |
| M34F | PSMA.49 | QVQLVESGGGVVQPGRSLRLSCAASGRTFGIYVFGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9236) | AC3259 |
| M34W | PSMA.50 | QVQLVESGGGVVQPGRSLRLSCAASGRTFGIYVWGWVRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9244) | AC3260 |
| V37A | PSMA.51 | QVQLVESGGGVVQPGRSLRLSCAASGRTFGIYVMGWARQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9245) | AC3261 |
| V37I | PSMA.52 | QVQLVESGGGVVQPGRSLRLSCAASGRTFGIYVMGWIRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9246) | AC3262 |
| V37F | PSMA.53 | QVQLVESGGGVVQPGRSLRLSCAASGRTFGIYVMGWFRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9247) | AC3263 |

TABLE 10a-continued

PSMA VHH sequences from Pool 1

| Mutation | PSMA domain | Sequence | Clone # the VHH was used in Together with CD3.23 |
|---|---|---|---|
| V37P | PSMA.54 | QVQLVESGGGVVQPGRSLRLSCAASGRTFGIYVMGWPRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9248) | AC3264 |
| V37Y | PSMA.55 | QVQLVESGGGVVQPGRSLRLSCAASGRTFGIYVMGWYRQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9249) | AC3265 |
| R38Q | PSMA.56 | QVQLVESGGGVVQPGRSLRLSCAASGRTFGIYVMGWVQQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9250) | AC3266 |
| R38K | PSMA.57 | QVQLVESGGGVVQPGRSLRLSCAASGRTFGIYVMGWVKQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9251) | AC3267 |
| R38S | PSMA.58 | QVQLVESGGGVVQPGRSLRLSCAASGRTFGIYVMGWVSQAPGKEREFVAAISWSGSNRLVSDSVKGRFTISRDNSKNTLYLQMNSLRAEDTAVYYCAASNRLYGRTWYDFNESDYWGQGTQVTVSS (SEQ ID NO: 9252) | AC3268 |
| F47L | PSMA.59 | QVQLVESGGGVVQPGRSLRLSCAASGRTFGIYVMGWVRQAPGKERELVAAISWSGSNRLVSDSVKGRFTISRDNSKNTLYLQMNSLRAEDTAVYYCAASNRLYGRTWYDFNESDYWGQGTQVTVSS (SEQ ID NO: 9253) | AC3269 |
| F47W | PSMA.60 | QVQLVESGGGVVQPGRSLRLSCAASGRTFGIYVMGWVRQAPGKEREWVAAISWSGSNRLVSDSVKGRFTISRDNSKNTLYLQMNSLRAEDTAVYYCAASNRLYGRTWYDFNESDYWGQGTQVTVSS (SEQ ID NO: 9254) | AC3270 |
| F47Y | PSMA.61 | QVQLVESGGGVVQPGRSLRLSCAASGRTFGIYVMGWVRQAPGKEREYVAAISWSGSNRLVSDSVKGRFTISRDNSKNTLYLQMNSLRAEDTAVYYCAASNRLYGRTWYDFNESDYWGQGTQVTVSS (SEQ ID NO: 9255) | AC3271 |
| V48W | PSMA.62 | QVQLVESGGGVVQPGRSLRLSCAASGRTFGIYVMGWVRQAPGKEREFWAAISWSGSNRLVSDSVKGRFTISRDNSKNTLYLQMNSLRAEDTAVYYCAASNRLYGRTWYDFNESDYWGQGTQVTVSS (SEQ ID NO: 9256) | AC3272 |
| A49G | PSMA.63 | QVQLVESGGGVVQPGRSLRLSCAASGRTFGIYVMGWVRQAPGKEREFVGAISWSGSNRLVSDSVKGRFTISRDNSKNTLYLQMNSLRAEDTAVYYCAASNRLYGRTWYDFNESDYWGQGTQVTVSS (SEQ ID NO: 9257) | AC3273 |
| I51A | PSMA.64 | QVQLVESGGGVVQPGRSLRLSCAASGRTFGIYVMGWVRQAPGKEREFVAAASWSGSNRLVSDSVKGRFTISRDNSKNTLYLQMNSLRAEDTAVYYCAASNRLYGRTWYDFNESDYWGQGTQVTVSS (SEQ ID NO: 9258) | AC3274 |
| I51R | PSMA.65 | QVQLVESGGGVVQPGRSLRLSCAASGRTFGIYVMGWVRQAPGKEREFVAARSWSGSNRLVSDSVKGRFTISRDNSKNTLYLQMNSLRAEDTAVYYCAASNRLYGRTWYDFNESDYWGQGTQVTVSS (SEQ ID NO: 9259) | AC3275 |

TABLE 10a-continued

PSMA VHH sequences from Pool 1

| Mutation | PSMA domain | Sequence | Clone # the VHH was used in Together with CD3.23 |
|---|---|---|---|
| I51E | PSMA.66 | QVQLVESGGGVVQPGRSLRLSCAASGRTFGIYV MGWVRQAPGKEREFVAAESWSGSNRLVSDSV KGRFTISRDNSKNTLYLQMNSLRAEDTAVYYCA ASNRLYGRTWYDFNESDYWGQGTQVTVSS (SEQ ID NO: 9260) | AC3276 |
| I51Q | PSMA.67 | QVQLVESGGGVVQPGRSLRLSCAASGRTFGIYV MGWVRQAPGKEREFVAAQSWSGSNRLVSDSV KGRFTISRDNSKNTLYLQMNSLRAEDTAVYYCA ASNRLYGRTWYDFNESDYWGQGTQVTVSS (SEQ ID NO: 9261) | AC3277 |
| I51G | PSMA.68 | QVQLVESGGGVVQPGRSLRLSCAASGRTFGIYV MGWVRQAPGKEREFVAAGSWSGSNRLVSDSV KGRFTISRDNSKNTLYLQMNSLRAEDTAVYYCA ASNRLYGRTWYDFNESDYWGQGTQVTVSS (SEQ ID NO: 9262) | AC3278 |
| I51H | PSMA.69 | QVQLVESGGGVVQPGRSLRLSCAASGRTFGIYV MGWVRQAPGKEREFVAAHSWSGSNRLVSDSV KGRFTISRDNSKNTLYLQMNSLRAEDTAVYYCA ASNRLYGRTWYDFNESDYWGQGTQVTVSS (SEQ ID NO: 9263) | AC3279 |
| I51M | PSMA.70 | QVQLVESGGGVVQPGRSLRLSCAASGRTFGIYV MGWVRQAPGKEREFVAAMSWSGSNRLVSDSV KGRFTISRDNSKNTLYLQMNSLRAEDTAVYYCA ASNRLYGRTWYDFNESDYWGQGTQVTVSS (SEQ ID NO: 9264) | AC3280 |
| I51P | PSMA.71 | QVQLVESGGGVVQPGRSLRLSCAASGRTFGIYV MGWVRQAPGKEREFVAAPSWSGSNRLVSDSV KGRFTISRDNSKNTLYLQMNSLRAEDTAVYYCA ASNRLYGRTWYDFNESDYWGQGTQVTVSS (SEQ ID NO: 9265) | AC3281 |
| I51S | PSMA.72 | QVQLVESGGGVVQPGRSLRLSCAASGRTFGIYV MGWVRQAPGKEREFVAASSWSGSNRLVSDSV KGRFTISRDNSKNTLYLQMNSLRAEDTAVYYCA ASNRLYGRTWYDFNESDYWGQGTQVTVSS (SEQ ID NO: 9266) | AC3282 |
| I51W | PSMA.73 | QVQLVESGGGVVQPGRSLRLSCAASGRTFGIYV MGWVRQAPGKEREFVAAWSWSGSNRLVSDSV KGRFTISRDNSKNTLYLQMNSLRAEDTAVYYCA ASNRLYGRTWYDFNESDYWGQGTQVTVSS (SEQ ID NO: 9267) | AC3283 |
| I51V | PSMA.74 | QVQLVESGGGVVQPGRSLRLSCAASGRTFGIYV MGWVRQAPGKEREFVAAVSWSGSNRLVSDSV KGRFTISRDNSKNTLYLQMNSLRAEDTAVYYCA ASNRLYGRTWYDFNESDYWGQGTQVTVSS (SEQ ID NO: 9268) | AC3284 |
| S52A | PSMA.75 | QVQLVESGGGVVQPGRSLRLSCAASGRTFGIYV MGWVRQAPGKEREFVAAIAWSGSNRLVSDSVK GRFTISRDNSKNTLYLQMNSLRAEDTAVYYCAA SNRLYGRTWYDFNESDYWGQGTQVTVSS (SEQ ID NO: 9269) | AC3285 |
| S52D | PSMA.76 | QVQLVESGGGVVQPGRSLRLSCAASGRTFGIYV MGWVRQAPGKEREFVAAIDWSGSNRLVSDSVK GRFTISRDNSKNTLYLQMNSLRAEDTAVYYCAA SNRLYGRTWYDFNESDYWGQGTQVTVSS (SEQ ID NO: 9270) | AC3286 |
| S52E | PSMA.77 | QVQLVESGGGVVQPGRSLRLSCAASGRTFGIYV MGWVRQAPGKEREFVAAIEWSGSNRLVSDSVK GRFTISRDNSKNTLYLQMNSLRAEDTAVYYCAA SNRLYGRTWYDFNESDYWGQGTQVTVSS (SEQ ID NO: 9271) | AC3287 |

TABLE 10a-continued

PSMA VHH sequences from Pool 1

| Mutation | PSMA domain | Sequence | Clone # the VHH was used in Together with CD3.23 |
|---|---|---|---|
| S52G | PSMA.78 | QVQLVESGGGVVQPGRSLRLSCAASGRTFGIYV MGWVRQAPGKEREFVAAWSWSGSNRLVSDSV KGRFTISRDNSKNTLYLQMNSLRAEDTAVYYCA ASNRLYGRTWYDFNESDYWGQGTQVTVSS (SEQ ID NO: 9267) | AC3288 |
| S52H | PSMA.79 | QVQLVESGGGVVQPGRSLRLSCAASGRTFGIYV MGWVRQAPGKEREFVAAIHWSGSNRLVSDSVK GRFTISRDNSKNTLYLQMNSLRAEDTAVYYCAA SNRLYGRTWYDFNESDYWGQGTQVTVSS (SEQ ID NO: 9272) | AC3289 |
| S52P | PSMA.80 | QVQLVESGGGVVQPGRSLRLSCAASGRTFGIYV MGWVRQAPGKEREFVAAIPWSGSNRLVSDSVK GRFTISRDNSKNTLYLQMNSLRAEDTAVYYCAA SNRLYGRTWYDFNESDYWGQGTQVTVSS (SEQ ID NO: 9273) | AC3290 |
| S52T | PSMA.81 | QVQLVESGGGVVQPGRSLRLSCAASGRTFGIYV MGWVRQAPGKEREFVAAITWSGSNRLVSDSVK GRFTISRDNSKNTLYLQMNSLRAEDTAVYYCAA SNRLYGRTWYDFNESDYWGQGTQVTVSS (SEQ ID NO: 9274) | AC3291 |
| S52W | PSMA.82 | QVQLVESGGGVVQPGRSLRLSCAASGRTFGIYV MGWVRQAPGKEREFVAAIWWSGSNRLVSDSV KGRFTISRDNSKNTLYLQMNSLRAEDTAVYYCA ASNRLYGRTWYDFNESDYWGQGTQVTVSS (SEQ ID NO: 9275) | AC3292 |
| S52Y | PSMA.83 | QVQLVESGGGVVQPGRSLRLSCAASGRTFGIYV MGWVRQAPGKEREFVAAIYWSGSNRLVSDSVK GRFTISRDNSKNTLYLQMNSLRAEDTAVYYCAA SNRLYGRTWYDFNESDYWGQGTQVTVSS (SEQ ID NO: 9276) | AC3293 |
| W53V | PSMA.84 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3294 |
| S54A | PSMA.85 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3295 |
| S54D | PSMA.86 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3296 |
| S54E | PSMA.87 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3297 |
| S54Q | PSMA.88 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3298 |
| S54G | PSMA.89 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3299 |

TABLE 10a-continued

PSMA VHH sequences from Pool 1

| Mutation | PSMA domain | Sequence | Clone # the VHH was used in Together with CD3.23 |
|---|---|---|---|
| S54K | PSMA.90 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3300 |
| S54P | PSMA.91 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3301 |
| S54W | PSMA.92 | QVQLVESGGGVVQPGRSLRLSCAASGRTFGIYV MGWVRQAPGKEREFVAAISWWGSNRLVSDSV KGRFTISRDNSKNTLYLQMNSLRAEDTAVYYCA ASNRLYGRTWYDFNESDYWGQGTQVTVSS (SEQ ID NO: 9278) | AC3302 |
| G55D | PSMA.93 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3303 |
| S56A | PSMA.94 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3304 |
| S56N | PSMA.95 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3305 |
| S56E | PSMA.96 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3306 |
| S56Q | PSMA.97 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3307 |
| S56G | PSMA.98 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3308 |
| S56H | PSMA.99 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3309 |
| S56L | PSMA.100 | QVQLVESGGGVVQPGRSLRLSCAASGRTFGIYV MGWVRQAPGKEREFVAAISWSGLNRLVSDSVK GRFTISRDNSKNTLYLQMNSLRAEDTAVYYCAA SNRLYGRTWYDFNESDYWGQGTQVTVSS (SEQ ID NO: 9279) | AC3310 |
| S56P | PSMA.101 | QVQLVESGGGVVQPGRSLRLSCAASGRTFGIYV MGWVRQAPGKEREFVAAISWSGPNRLVSDSVK GRFTISRDNSKNTLYLQMNSLRAEDTAVYYCAA SNRLYGRTWYDFNESDYWGQGTQVTVSS (SEQ ID NO: 9280) | AC3311 |

TABLE 10a-continued

PSMA VHH sequences from Pool 1

| Mutation | PSMA domain | Sequence | Clone # the VHH was used in Together with CD3.23 |
|---|---|---|---|
| S56T | PSMA.102 | QVQLVESGGGVVQPGRSLRLSCAASGRTFGIYV MGWVRQAPGKEREFVAAISWSGTNRLVSDSVK GRFTISRDNSKNTLYLQMNSLRAEDTAVYYCAA SNRLYGRTWYDFNESDYWGQGTQVTVSS (SEQ ID NO: 9281) | AC3312 |
| N57D | PSMA.103 | QVQLVESGGGVVQPGRSLRLSCAASGRTFGIYV MGWVRQAPGKEREFVAAISWSGSDRLVSDSVK GRFTISRDNSKNTLYLQMNSLRAEDTAVYYCAA SNRLYGRTWYDFNESDYWGQGTQVTVSS (SEQ ID NO: 9282) | AC3313 |
| N57Q | PSMA.104 | QVQLVESGGGVVQPGRSLRLSCAASGRTFGIYV MGWVRQAPGKEREFVAAISWSGSQRLVSDSVK GRFTISRDNSKNTLYLQMNSLRAEDTAVYYCAA SNRLYGRTWYDFNESDYWGQGTQVTVSS (SEQ ID NO: 9283) | AC3314 |
| N57G | PSMA.105 | QVQLVESGGGVVQPGRSLRLSCAASGRTFGIYV MGWVRQAPGKEREFVAAISWSGSGRLVSDSVK GRFTISRDNSKNTLYLQMNSLRAEDTAVYYCAA SNRLYGRTWYDFNESDYWGQGTQVTVSS (SEQ ID NO: 9284) | AC3315 |
| N57H | PSMA.106 | QVQLVESGGGVVQPGRSLRLSCAASGRTFGIYV MGWVRQAPGKEREFVAAISWSGSHRLVSDSVK GRFTISRDNSKNTLYLQMNSLRAEDTAVYYCAA SNRLYGRTWYDFNESDYWGQGTQVTVSS (SEQ ID NO: 9285) | AC3316 |
| N57F | PSMA.107 | QVQLVESGGGVVQPGRSLRLSCAASGRTFGIYV MGWVRQAPGKEREFVAAISWSGSFRLVSDSVK GRFTISRDNSKNTLYLQMNSLRAEDTAVYYCAA SNRLYGRTWYDFNESDYWGQGTQVTVSS (SEQ ID NO: 9286) | AC3317 |
| N57P | PSMA.108 | QVQLVESGGGVVQPGRSLRLSCAASGRTFGIYV MGWVRQAPGKEREFVAAISWSGSPRLVSDSVK GRFTISRDNSKNTLYLQMNSLRAEDTAVYYCAA SNRLYGRTWYDFNESDYWGQGTQVTVSS (SEQ ID NO: 9287) | AC3318 |
| R58A | PSMA.109 | QVQLVESGGGVVQPGRSLRLSCAASGRTFGIYV MGWVRQAPGKEREFVAAISWSGSNALVSDSVK GRFTISRDNSKNTLYLQMNSLRAEDTAVYYCAA SNRLYGRTWYDFNESDYWGQGTQVTVSS (SEQ ID NO: 9288) | AC3319 |
| R58Q | PSMA.110 | QVQLVESGGGVVQPGRSLRLSCAASGRTFGIYV MGWVRQAPGKEREFVAAISWSGSNQLVSDSVK GRFTISRDNSKNTLYLQMNSLRAEDTAVYYCAA SNRLYGRTWYDFNESDYWGQGTQVTVSS (SEQ ID NO: 9289) | AC3320 |
| R58I | PSMA.111 | QVQLVESGGGVVQPGRSLRLSCAASGRTFGIYV MGWVRQAPGKEREFVAAISWSGSNILVSDSVK GRFTISRDNSKNTLYLQMNSLRAEDTAVYYCAA SNRLYGRTWYDFNESDYWGQGTQVTVSS (SEQ ID NO: 9290) | AC3321 |
| R58T | PSMA.112 | QVQLVESGGGVVQPGRSLRLSCAASGRTFGIYV MGWVRQAPGKEREFVAAISWSGSNTLVSDSVK GRFTISRDNSKNTLYLQMNSLRAEDTAVYYCAA SNRLYGRTWYDFNESDYWGQGTQVTVSS (SEQ ID NO: 9291) | AC3322 |
| L59A | PSMA.113 | QVQLVESGGGVVQPGRSLRLSCAASGRTFGIYV MGWVRQAPGKEREFVAAISWSGSNRAVSDSVK GRFTISRDNSKNTLYLQMNSLRAEDTAVYYCAA SNRLYGRTWYDFNESDYWGQGTQVTVSS (SEQ ID NO: 9292) | AC3323 |

TABLE 10a-continued

PSMA VHH sequences from Pool 1

| Mutation | PSMA domain | Sequence | Clone # the VHH was used in Together with CD3.23 |
|---|---|---|---|
| L59N | PSMA.114 | QVQLVESGGGVVQPGRSLRLSCAASGRTFGIYV MGWVRQAPGKEREFVAAISWSGSNRNVSDSVK GRFTISRDNSKNTLYLQMNSLRAEDTAVYYCAA SNRLYGRTWYDFNESDYWGQGTQVTVSS (SEQ ID NO: 9293) | AC3324 |
| L59E | PSMA.115 | QVQLVESGGGVVQPGRSLRLSCAASGRTFGIYV MGWVRQAPGKEREFVAAISWSGSNREVSDSVK GRFTISRDNSKNTLYLQMNSLRAEDTAVYYCAA SNRLYGRTWYDFNESDYWGQGTQVTVSS (SEQ ID NO: 9294) | AC3325 |
| L59Q | PSMA.116 | QVQLVESGGGVVQPGRSLRLSCAASGRTFGIYV MGWVRQAPGKEREFVAAISWSGSNRQVSDSVK GRFTISRDNSKNTLYLQMNSLRAEDTAVYYCAA SNRLYGRTWYDFNESDYWGQGTQVTVSS (SEQ ID NO: 9295) | AC3326 |
| L59G | PSMA.117 | QVQLVESGGGVVQPGRSLRLSCAASGRTFGIYV MGWVRQAPGKEREFVAAISWSGSNRGVSDSVK GRFTISRDNSKNTLYLQMNSLRAEDTAVYYCAA SNRLYGRTWYDFNESDYWGQGTQVTVSS (SEQ ID NO: 9296) | AC3327 |
| L59H | PSMA.118 | QVQLVESGGGVVQPGRSLRLSCAASGRTFGIYV MGWVRQAPGKEREFVAAISWSGSNRHVSDSVK GRFTISRDNSKNTLYLQMNSLRAEDTAVYYCAA SNRLYGRTWYDFNESDYWGQGTQVTVSS (SEQ ID NO: 9297) | AC3328 |
| L59K | PSMA.119 | QVQLVESGGGVVQPGRSLRLSCAASGRTFGIYV MGWVRQAPGKEREFVAAISWSGSNRKVSDSVK GRFTISRDNSKNTLYLQMNSLRAEDTAVYYCAA SNRLYGRTWYDFNESDYWGQGTQVTVSS (SEQ ID NO: 9298) | AC3329 |
| L59M | PSMA.120 | QVQLVESGGGVVQPGRSLRLSCAASGRTFGIYV MGWVRQAPGKEREFVAAISWSGSNRMVSDSV KGRFTISRDNSKNTLYLQMNSLRAEDTAVYYCA ASNRLYGRTWYDFNESDYWGQGTQVTVSS (SEQ ID NO: 9299) | AC3330 |
| L59P | PSMA.121 | QVQLVESGGGVVQPGRSLRLSCAASGRTFGIYV MGWVRQAPGKEREFVAAISWSGSNRPVSDSVK GRFTISRDNSKNTLYLQMNSLRAEDTAVYYCAA SNRLYGRTWYDFNESDYWGQGTQVTVSS (SEQ ID NO: 9300) | AC3331 |
| L59S | PSMA.122 | QVQLVESGGGVVQPGRSLRLSCAASGRTFGIYV MGWVRQAPGKEREFVAAISWSGSNRSVSDSVK GRFTISRDNSKNTLYLQMNSLRAEDTAVYYCAA SNRLYGRTWYDFNESDYWGQGTQVTVSS (SEQ ID NO: 9301) | AC3332 |
| L59T | PSMA.123 | QVQLVESGGGVVQPGRSLRLSCAASGRTFGIYV MGWVRQAPGKEREFVAAISWSGSNRTVSDSVK GRFTISRDNSKNTLYLQMNSLRAEDTAVYYCAA SNRLYGRTWYDFNESDYWGQGTQVTVSS (SEQ ID NO: 9302) | AC3333 |
| L59Y | PSMA.124 | QVQLVESGGGVVQPGRSLRLSCAASGRTFGIYV MGWVRQAPGKEREFVAAISWSGSNRYVSDSVK GRFTISRDNSKNTLYLQMNSLRAEDTAVYYCAA SNRLYGRTWYDFNESDYWGQGTQVTVSS (SEQ ID NO: 9303) | AC3334 |
| V60Y | PSMA.125 | QVQLVESGGGVVQPGRSLRLSCAASGRTFGIYV MGWVRQAPGKEREFVAAISWSGSNRLYSDSVK GRFTISRDNSKNTLYLQMNSLRAEDTAVYYCAA SNRLYGRTWYDFNESDYWGQGTQVTVSS (SEQ ID NO: 9304) | AC3335 |

TABLE 10a-continued

PSMA VHH sequences from Pool 1

| Mutation | PSMA domain | Sequence | Clone # the VHH was used in Together with CD3.23 |
|---|---|---|---|
| R67Q | PSMA.126 | QVQLVESGGGVVQPGRSLRLSCAASGRTFGIYV MGWVRQAPGKEREFVAAISWSGSNRLVSDSVK GQFTISRDNSKNTLYLQMNSLRAEDTAVYYCAA SNRLYGRTWYDFNESDYWGQGTQVTVSS (SEQ ID NO: 9305) | AC3336 |
| S99E | PSMA.127 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA ENRLYGRTWYDFNESDYWGQGTQVTVSS (SEQ ID NO: 9306) | AC3337 |
| S99Q | PSMA.128 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA HNRLYGRTWYDFNESDYWGQGTQVTVSS (SEQ ID NO: 9307) | AC3338 |
| S99H | PSMA.129 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA YNRLYGRTWYDFNESDYWGQGTQVTVSS (SEQ ID NO: 9308) | AC3339 |
| S99Y | PSMA.130 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA QNRLYGRTWYDFNESDYWGQGTQVTVSS (SEQ ID NO: 9309) | AC3340 |
| N100E | PSMA.131 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SERLYGRTWYDFNESDYWGQGTQVTVSS (SEQ ID NO: 9310) | AC3341 |
| R101K | PSMA.132 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNKLYGRTWYDFNESDYWGQGTQVTVSS (SEQ ID NO: 9311) | AC3342 |
| L102A | PSMA.133 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRAYGRTWYDFNESDYWGQGTQVTVSS (SEQ ID NO: 9312) | AC3343 |
| L102Q | PSMA.134 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRQYGRTWYDFNESDYWGQGTQVTVSS (SEQ ID NO: 9313) | AC3344 |
| L102H | PSMA.135 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRHYGRTWYDFNESDYWGQGTQVTVSS (SEQ ID NO: 9314) | AC3345 |
| L102K | PSMA.136 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRKYGRTWYDFNESDYWGQGTQVTVSS (SEQ ID NO: 9315) | AC3346 |
| L102M | PSMA.137 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRMYGRTWYDFNESDYWGQGTQVTVSS (SEQ ID NO: 9316) | AC3347 |

TABLE 10a-continued

PSMA VHH sequences from Pool 1

| Mutation | PSMA domain | Sequence | Clone # the VHH was used in Together with CD3.23 |
|---|---|---|---|
| L102F | PSMA.138 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRFYGRTWYDFNESDYWGQGTQVTVSS (SEQ ID NO: 9317) | AC3348 |
| L102P | PSMA.139 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRPYGRTWYDFNESDYWGQGTQVTVSS (SEQ ID NO: 9318) | AC3349 |
| L102T | PSMA.140 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRTYGRTWYDFNESDYWGQGTQVTVSS (SEQ ID NO: 9319) | AC3350 |
| L102W | PSMA.141 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRWYGRTWYDFNESDYWGQGTQVTVSS (SEQ ID NO: 9320) | AC3351 |
| L102Y | PSMA.142 | QVQLVESGGGVVQPGRSLRLSCAASGRTFGIYV MGWVRQAPGKEREFVAAISWSGSNRLVSDSVK GRFTISRDNSKNTLYLQMNSLRAEDTAVYYCAA SNRYYGRTWYDFNESDYWGQGTQVTVSS (SEQ ID NO: 9277) | AC3352 |

TABLE 10b

PSMA VHH sequences from Pool 2

| PSMA domain | huPSMA Binding $K_D$ (nM) | PTE score | Sequence | AC Number |
|---|---|---|---|---|
| PSMA.5 | 4.8 | 69 | QVQLVESGGGVVQPGRSLRLSCAASG RTFGIYVMGWFRQAPGKEREFVAAMS WSGSNRKVSDSVKGRFTISRDNSKNT LYLQMNSLRAEDTAVYYCAASNRLYG RTWYDFNESDYWGQGTQVTVSS (SEQ ID NO: 9321) | AC2717 |
| PSMA.119 | 4.1 | 46 | QVQLVESGGGVVQPGRSLRLSCAASG RTFGIYVMGWVRQAPGKEREFVAAIS WSGSNRKVSDSVKGRFTISRDNSKNT LYLQMNSLRAEDTAVYYCAASNRLYG RTWYDFNESDYWGQGTQVTVSS (SEQ ID NO: 9298) | AC3329 |
| PSMA.250 | 6.2 | 26 | QVQLVESGGGVVQPGRSLRLSCAASG RTFGIYVMGWYRQAPGKEREFVAAMS WSGSNRKVSDSVKGRFTISRDNSKNT LYLQMNSLRAEDTAVYYCAASNKLYGR TWYDFNESDYWGQGTQVTVSS (SEQ ID NO: 9322) | AC3461 |
| PSMA.251 | 5.1 | 27 | QVQLVESGGGVVQPGRSLRLSCAASG RTFGIYVMGWYRQAPGKEREFVAAIS WSGSNRKVSDSVKGRFTISRDNSKNT LYLQMNSLRAEDTAVYYCAASNKLYGR TWYDFNESDYWGQGTQVTVSS (SEQ ID NO: 9323) | AC3462 |
| PSMA.252 | 15.9 | 15 | QVQLVESGGGVVQPGRSLRLSCAASG RTFGIYVMGWYRQAPGKEREFVAAMS WSGSNRKVSDSVKGRFTISRDNSKNT | AC3463 |

TABLE 10b-continued

PSMA VHH sequences from Pool 2

| PSMA domain | huPSMA Binding $K_D$ (nM) | PTE score | Sequence | AC Number |
|---|---|---|---|---|
| | | | LYLQMNSLRAEDTAVYYCAASNRWYG RTWYDFNESDYWGQGTQVTVSS (SEQ ID NO: 9324) | |
| PSMA.253 | 8.5 | 16 | QVQLVESGGGVVQPGRSLRLSCAASG RTFGIYVMGWYRQAPGKEREFVAAIS WSGSNRKVSDSVKGRFTISRDNSKNT LYLQMNSLRAEDTAVYYCAASNRWYG RTWYDFNESDYWGQGTQVTVSS (SEQ ID NO: 9325) | AC3464 |
| PSMA.254 | 41.0 | 15 | QVQLVESGGGVVQPGRSLRLSCAASG RTFGIYVMGWYRQAPGKEREFVAAMS WSGSNRKVSDSVKGRFTISRDNSKNT LYLQMNSLRAEDTAVYYCAASNRYYG RTWYDFNESDYWGQGTQVTVSS (SEQ ID NO: 9326) | AC3465 |
| PSMA.255 | 18.9 | 16 | QVQLVESGGGVVQPGRSLRLSCAASG RTFGIYVMGWYRQAPGKEREFVAAIS WSGSNRKVSDSVKGRFTISRDNSKNT LYLQMNSLRAEDTAVYYCAASNRYYG RTWYDFNESDYWGQGTQVTVSS (SEQ ID NO: 9327) | AC3466 |
| PSMA.256 | 3.4 | 29 | QVQLVESGGGVVQPGRSLRLSCAASG RTFGIYVMGWYRQAPGKEREFVAAMS WSGSNRKVSDSVKGRFTISRDNSKNT LYLQMNSLRAEDTAVYYCAASNRLYG RTWYDFNESDYWGQGTQVTVSS (SEQ ID NO: 9328) | AC3467 |
| PSMA.257 | 2.3 | 30 | QVQLVESGGGVVQPGRSLRLSCAASG RTFGIYVMGWYRQAPGKEREFVAAIS WSGSNRKVSDSVKGRFTISRDNSKNT LYLQMNSLRAEDTAVYYCAASNRLYG RTWYDFNESDYWGQGTQVTVSS (SEQ ID NO: 9329) | AC3468 |
| PSMA.260 | 11.4 | 23 | QVQLVESGGGVVQPGRSLRLSCAASG RTFGIYAMGWVRQAPGKEREFVGAIS WSGSNRKVSDSVKGRFTISRDNSKNT LYLQMNSLRAEDTAVYYCAASNKLYGR TWYDFNESDYWGQGTQVTVSS (SEQ ID NO: 9330) | AC3469 |
| PSMA.261 | 2.1 | 23 | QVQLVESGGGVVQPGRSLRLSCAASG RTFGIYVFGWVRQAPGKEREFVGAIS WSGSNRKVSDSVKGRFTISRDNSKNT LYLQMNSLRAEDTAVYYCAASNKLYGR TWYDFNESDYWGQGTQVTVSS (SEQ ID NO: 9331) | AC3470 |
| PSMA.262 | 2.7 | 23 | QVQLVESGGGVVQPGRSLRLSCAASG RTFGIYVWGWVRQAPGKEREFVGAIS WSGSNRKVSDSVKGRFTISRDNSKNT LYLQMNSLRAEDTAVYYCAASNKLYGR TWYDFNESDYWGQGTQVTVSS (SEQ ID NO: 9332) | AC3471 |
| PSMA.263 | Not Determined | 23 | QVQLVESGGGVVQPGRSLRLSCAASG RTFGIYVMGWFRQAPGKEREFVGAIS WSGSNRKVSDSVKGRFTISRDNSKNT LYLQMNSLRAEDTAVYYCAASNKLYGR TWYDFNESDYWGQGTQVTVSS (SEQ ID NO: 9333) | AC3472 |
| PSMA.264 | 18.6 | 26 | QVQLVESGGGVVQPGRSLRLSCAASG RTFGIYAMGWVRQAPGKEREFVAAMS WSGSNRKVSDSVKGRFTISRDNSKNT LYLQMNSLRAEDTAVYYCAASNKLYGR TWYDFNESDYWGQGTQVTVSS (SEQ ID NO: 9334) | AC3473 |

TABLE 10b-continued

PSMA VHH sequences from Pool 2

| PSMA domain | huPSMA Binding $K_D$ (nM) | PTE score | Sequence | AC Number |
|---|---|---|---|---|
| PSMA.265 | 3.9 | 26 | QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNKLYGRTWYDFNESDYWGQGTQVTVSS (SEQ ID NO: 9335) | AC3474 |
| PSMA.266 | 4.6 | 26 | QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNKLYGRTWYDFNESDYWGQGTQVTVSS (SEQ ID NO: 9336) | AC3475 |
| PSMA.267 | 5.6 | 20 | QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNKLYGRTWYDFNESDYWGQGTQVTVSS (SEQ ID NO: 9337) | AC3476 |
| PSMA.268 | 131.3 | 20 | QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNRTYGRTWYDFNESDYWGQGTQVTVSS (SEQ ID NO: 9338) | AC3477 |
| PSMA.269 | 5.5 | 20 | QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNRTYGRTWYDFNESDYWGQGTQVTVSS (SEQ ID NO: 9339) | AC3478 |
| PSMA.270 | 6.5 | 20 | QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNRTYGRTWYDFNESDYWGQGTQVTVSS (SEQ ID NO: 9340) | AC3479 |
| PSMA.271 | 9.1 | 23 | QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNRTYGRTWYDFNESDYWGQGTQVTVSS (SEQ ID NO: 9341) | AC3480 |
| PSMA.272 | 503.7 | 23 | QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNRTYGRTWYDFNESDYWGQGTQVTVSS (SEQ ID NO: 9342) | AC3481 |
| PSMA.273 | 16.6 | 23 | QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNRTYGRTWYDFNESDYWGQGTQVTVSS (SEQ ID NO: 9343) | AC3482 |
| PSMA.274 | 39.6 | 23 | QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNRTYGRTWYDFNESDYWGQGTQVTVSS (SEQ ID NO: 9344) | AC3483 |

TABLE 10b-continued

PSMA VHH sequences from Pool 2

| PSMA domain | huPSMA Binding $K_D$ (nM) | PTE score | Sequence | AC Number |
|---|---|---|---|---|
| PSMA.275 | 20.5 | 24 | QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNRTYGRTWYDFNESDYWGQGTQVTVSS (SEQ ID NO: 9345) | AC3484 |
| PSMA.276 | 10.5 | 24 | QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNRMYGRTWYDFNESDYWGQGTQVTVSS (SEQ ID NO: 9346) | AC3485 |
| PSMA.277 | 3.1 | 24 | QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNRMYGRTWYDFNESDYWGQGTQVTVSS (SEQ ID NO: 9347) | AC3486 |
| PSMA.278 | 3.9 | 24 | QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNRMYGRTWYDFNESDYWGQGTQVTVSS (SEQ ID NO: 9348) | AC3487 |
| PSMA.279 | 2.3 | 27 | QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNRMYGRTWYDFNESDYWGQGTQVTVSS (SEQ ID NO: 9349) | AC3488 |
| PSMA.280 | 16.3 | 27 | QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNRMYGRTWYDFNESDYWGQGTQVTVSS (SEQ ID NO: 9350) | AC3489 |
| PSMA.281 | 5.3 | 27 | QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNRMYGRTWYDFNESDYWGQGTQVTVSS (SEQ ID NO: 9351) | AC3490 |
| PSMA.282 | 8.7 | 27 | QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNRMYGRTWYDFNESDYWGQGTQVTVSS (SEQ ID NO: 9352) | AC3491 |
| PSMA.283 | 3.5 | 26 | QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNRMYGRTWYDFNESDYWGQGTQVTVSS (SEQ ID NO: 9353) | AC3492 |
| PSMA.284 | 4.1 | 26 | QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNRLYGRTWYDFNESDYWGQGTQVTVSS (SEQ ID NO: 9354) | AC3493 |

TABLE 10b-continued

PSMA VHH sequences from Pool 2

| PSMA domain | huPSMA Binding $K_D$ (nM) | PTE score | Sequence | AC Number |
|---|---|---|---|---|
| PSMA.285 | 3.1 | 26 | QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNRLYGRTWYDFNESDYWGQGTQVTVSS (SEQ ID NO: 9355) | AC3494 |
| PSMA.286 | No Binding | 26 | QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNRLYGRTWYDFNESDYWGQGTQVTVSS (SEQ ID NO: 9356) | AC3495 |
| PSMA.287 | 2.3 | 29 | QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNRLYGRTWYDFNESDYWGQGTQVTVSS (SEQ ID NO: 9357) | AC3496 |
| PSMA.288 | 6.0 | 29 | QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNRLYGRTWYDFNESDYWGQGTQVTVSS (SEQ ID NO: 9358) | AC3497 |
| PSMA.289 | 6.2 |  | QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNRLYGRTWYDFNESDYWGQGTQVTVSS (SEQ ID NO: 9359) | AC3498 |
| PSMA.290 | 5.5 | 29 | QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNRLYGRTWYDFNESDYWGQGTQVTVSS (SEQ ID NO: 9360) | AC3499 |
| PSMA.291 | 2.6 | 29 | QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNRLYGRTWYDFNESDYWGQGTQVTVSS (SEQ ID NO: 9321) | AC3500 |

TABLE 10c

PSMA VHH sequences from Pool 3

| PSMA domain | huPSMA Binding $K_D$ (nM) | PTE score | Sequence | AC Number | SEQ ID NO |
|---|---|---|---|---|---|
| PSMA.301 | 10.0 | 23 | QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAASNKLYGRTWYDFNESDYWGQGTQVTVSS | AC3703 | 500 |
| PSMA.302 | 2.8 | 16 | QVQLVESGGGVVQPGRSLRLSCAASGRTFGIYVWGWFRQAPGKEREFVGAISWSGSNRKVSDSVKGRFTISRDNSKNTLYLQMNSLRAEDTAVYFCAASNKLYGRTWYDFNESDYWGQGTQVTVSS | AC3704 | 501 |

TABLE 10c-continued

PSMA VHH sequences from Pool 3

| PSMA domain | huPSMA Binding K$_D$ (nM) | PTE score | Sequence | AC Number | SEQ ID NO |
|---|---|---|---|---|---|
| PSMA.303 | 10.3 | 18 | QVQLVESGGGVVQPGRSLRLSCAAS GRTFGIYVMGWFRQAPGKEREFVGA MSWSGSNRKVSDSVKGRFTISRDNS KNTLYLQMNSLRAEDTAVYFCAASNK LYGRTWYDFNESDYWGQGTQVTVSS | AC3705 | 502 |
| PSMA.304 | 5.9 | 11 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCAASNK LYGRTWYDFNESDYWGQGTQVTVSS | AC3706 | 503 |
| PSMA.305 | N/D (has strong binding) | 16 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCAASNKL YGRTWYDFNESDYWGQGTQVTVSS | AC3707 | 504 |
| PSMA.306 | 10.4 | 18 | QVQLVESGGGVVQPGRSLRLSCAAS GRTFGIYVMGWFRQAPGKEREFVGA MSWSGSNRKVSDSVKGRFTISRDNS KNTLYLQMNSLRAEDTAVYYCAASNK LYGRTWYDFNESDYWGQGTQVTVSS | AC3708 | 505 |
| PSMA.307 | 6.0 | 11 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCAASNK LYGRTWYDFNESDYWGQGTQVTVSS | AC3709 | 506 |
| PSMA.308 | 8.8 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCAASNK WYGRTWYDFNESDYWGQGTQVTVSS | AC3710 | 507 |
| PSMA.309 | 8.5 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCAASNK WYGRTWYDFNESDYWGQGTQVTVSS | AC3711 | 508 |
| PSMA.310 | 23.1 | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCGGSNK LYGRTWYDFNESDYWGQGTQVTVSS | AC3712 | 509 |
| PSMA.311 | No Binding | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVDYCAASNKL YGRTWYDFNESDYWGQGTQVTVSS | AC3713 | 510 |
| PSMA.312 | 12.0 | 13 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCGASNKL YGRTWYDFNESDYWGQGTQVTVSS | AC3714 | 511 |
| PSMA.313 | No Binding | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCAASNK RYGRTWYDFNESDYWGQGTQVTVSS | AC3715 | 512 |

TABLE 10c-continued

PSMA VHH sequences from Pool 3

| PSMA domain | huPSMA Binding $K_D$ (nM) | PTE score | Sequence | AC Number | SEQ ID NO |
|---|---|---|---|---|---|
| PSMA.314 | 69.9 | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCAASNK DYGRTWYDFNESDYWGQGTQVTVS S | AC3716 | 513 |
| PSMA.315 | 24.2 | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCAASNKE YGRTWYDFNESDYWGQGTQVTVSS | AC3717 | 514 |
| PSMA.316 | 150.0 | 13 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYYCAASNK GYGRTWYDFNESDYWGQGTQVTVS S | AC3718 | 515 |
| PSMA.317 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVAYCAGSNKL YGRTWYDFNESDYWGQGTQVTVSS | AC3719 | 516 |
| PSMA.318 | No Binding | 16 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVRYCAGSNK LYGRTWYDFNESDYWGQGTQVTVS S | AC3720 | 517 |
| PSMA.319 | No Binding | 16 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVNYCAGSNK LYGRTWYDFNESDYWGQGTQVTVS S | AC3721 | 518 |
| PSMA.320 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVGYCAGSNK LYGRTWYDFNESDYWGQGTQVTVS S | AC3722 | 519 |
| PSMA.321 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVKYCAGSNKL YGRTWYDFNESDYWGQGTQVTVSS | AC3723 | 520 |
| PSMA.322 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVSYCAGSNKL YGRTWYDFNESDYWGQGTQVTVSS | AC3724 | 521 |
| PSMA.323 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVTYCAGSNKL YGRTWYDFNESDYWGQGTQVTVSS | AC3725 | 522 |
| PSMA.324 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVAFCAASNKL YGRTWYDFNESDYWGQGTQVTVSS | AC3726 | 523 |
| PSMA.325 | No Binding | 17 | QVQLVESGGGVVQPGRSLRLSCAAS GRTFGIYVMGWFRQAPGKEREFVGA ISWSGSNRKVSDSVKGRFTISRDNSK | AC3727 | 524 |

TABLE 10c-continued

PSMA VHH sequences from Pool 3

| PSMA domain | huPSMA Binding $K_D$ (nM) | PTE score | Sequence | AC Number | SEQ ID NO |
|---|---|---|---|---|---|
| | | | NTLYLQMNSLRAEDTAVRFCAASNKL YGRTWYDFNESDYWGQGTQVTVSS | | |
| PSMA.326 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVNFCAASNKL YGRTWYDFNESDYWGQGTQVTVSS | AC3728 | 525 |
| PSMA.327 | No Binding | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVDFCAASNKL YGRTWYDFNESDYWGQGTQVTVSS | AC3729 | 526 |
| PSMA.328 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVGFCAASNKL YGRTWYDFNESDYWGQGTQVTVSS | AC3730 | 527 |
| PSMA.329 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVKFCAASNKL YGRTWYDFNESDYWGQGTQVTVSS | AC3731 | 528 |
| PSMA.330 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVSFCAASNKL YGRTWYDFNESDYWGQGTQVTVSS | AC3732 | 529 |
| PSMA.331 | 12.1 | 14 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCGASNKL YGRTWYDFNESDYWGQGTQVTVSS | AC3733 | 530 |
| PSMA.332 | 24.1 | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCAGSNKL YGRTWYDFNESDYWGQGTQVTVSS | AC3734 | 531 |
| PSMA.333 | No Binding | 14 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCAASNKR YGRTWYDFNESDYWGQGTQVTVSS | AC3735 | 532 |
| PSMA.334 | 70.6 | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCAASNKD YGRTWYDFNESDYWGQGTQVTVSS | AC3736 | 533 |
| PSMA.335 | 24.8 | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCAASNKE YGRTWYDFNESDYWGQGTQVTVSS | AC3737 | 534 |
| PSMA.336 | 129.1 | 14 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCAASNK GYGRTWYDFNESDYWGQGTQVTVS S | AC3738 | 535 |

TABLE 10c-continued

PSMA VHH sequences from Pool 3

| PSMA domain | huPSMA Binding $K_D$ (nM) | PTE score | Sequence | AC Number | SEQ ID NO |
|---|---|---|---|---|---|
| PSMA.337 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVAFCAGSNKL YGRTWYDFNESDYWGQGTQVTVSS | AC3739 | 536 |
| PSMA.338 | No Binding | 16 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVRFCAGSNKL YGRTWYDFNESDYWGQGTQVTVSS | AC3740 | 537 |
| PSMA.339 | No Binding | 16 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVNFCAGSNKL YGRTWYDFNESDYWGQGTQVTVSS | AC3741 | 538 |
| PSMA.340 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVGFCAGSNK LYGRTWYDFNESDYWGQGTQVTVS S | AC3742 | 539 |
| PSMA.341 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVKFCAGSNKL YGRTWYDFNESDYWGQGTQVTVSS | AC3743 | 540 |
| PSMA.342 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVSFCAGSNKL YGRTWYDFNESDYWGQGTQVTVSS | AC3744 | 541 |
| PSMA.343 | No Binding | 17 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVTFCAGSNKL YGRTWYDFNESDYWGQGTQVTVSS | AC3745 | 542 |
| PSMA.344 | Not Determined | 12 | QVQLVESGGGVVQPGRSLRLSCAAS GRTFGIYVMGWFRQAPGKEREFVGA ISWSGSNRKVSDSVKGRFTISRDNSK NTLYLQMNSLRAEDTAVYFCGGSNK LYGRTWYDFNESDYWGQGTQVTVS S | None | 543 |
| PSMA.345 | 6.1 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCGGSN KLYGRTWYDFNESDYWGQGTQVTV SS | AC3747 | 544 |
| PSMA.346 | No Binding | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVDYCAASN KLYGRTWYDFNESDYWGQGTQVTV SS | AC3748 | 545 |
| PSMA.347 | 7.3 | 1 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCGASN KLYGRTWYDFNESDYWGQGTQVTV SS | AC3749 | 546 |
| PSMA.348 | 1149.0 | 0 | QVQLVESGGGVVQPGRSLRLSCAAS GRTFGIYVWGWFRQAPGKEREFVGA MSWSGSNRKVSDSVKGRFTISRDNS | AC3750 | 547 |

TABLE 10c-continued

PSMA VHH sequences from Pool 3

| PSMA domain | huPSMA Binding $K_D$ (nM) | PTE score | Sequence | AC Number | SEQ ID NO |
|---|---|---|---|---|---|
| | | | KNTLYLQMNSLRAEDTAVYYCAASNK RYGRTWYDFNESDYWGQGTQVTVS S | | |
| PSMA.349 | 18.0 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCAASNK DYGRTWYDFNESDYWGQGTQVTVS S | AC3751 | 548 |
| PSMA.350 | 7.4 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCAASNK EYGRTWYDFNESDYWGQGTQVTVS S | AC3752 | 549 |
| PSMA.351 | 32.6 | 1 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYYCAASNK GYGRTWYDFNESDYWGQGTQVTVS S | AC3753 | 550 |
| PSMA.352 | No Binding | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVDFCAASNK LYGRTWYDFNESDYWGQGTQVTVS S | AC3754 | 551 |
| PSMA.353 | 5.1 | 2 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCGASN KLYGRTWYDFNESDYWGQGTQVTV SS | AC3755 | 552 |
| PSMA.354 | 1089.0 | 2 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCAASNK RYGRTWYDFNESDYWGQGTQVTVS S | AC3756 | 553 |
| PSMA.355 | 17.8 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCAASNK DYGRTWYDFNESDYWGQGTQVTVS S | AC3757 | 554 |
| PSMA.356 | 7.8 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCAASNK EYGRTWYDFNESDYWGQGTQVTVS S | AC3758 | 555 |
| PSMA.357 | 24.6 | 2 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCAASNK GYGRTWYDFNESDYWGQGTQVTVS S | AC3759 | 556 |
| PSMA.358 | 6.5 | 0 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVYFCGGSN KLYGRTWYDFNESDYWGQGTQVTV SS | AC3760 | 557 |

TABLE 10c-continued

PSMA VHH sequences from Pool 3

| PSMA domain | huPSMA Binding K$_D$ (nM) | PTE score | Sequence | AC Number | SEQ ID NO |
|---|---|---|---|---|---|
| PSMA.359 | No Binding | 4 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVRYCAGSN KLYGRTWYDFNESDYWGQGTQVTV SS | AC3761 | 558 |
| PSMA.360 | No Binding | 4 | QVQLVESGGGVVQPGRSLRLSCAAS GRTFGIYVWGWFRQAPGKEREFVGA MSWSGSNRKVSDSVKGRFTISRDNS KNTLYLQMNSLRAEDTAVNYCAGSN KLYGRTWYDFNESDYWGQGTQVTV SS | AC3762 | 559 |

Example 4. PSMA Binding Analyses

PSMA binding kinetics were determined for select clones from the non-humanized antibodies against human PSMA. The binding affinity values are depicted below in Table 11. Each PSMA antibody was paired with the CD3 antibody CD3.23.

TABLE 11

Binding affinity for select PSMA antibodies

| SEQ ID NO | Description | K$_D$ (NM) | K$_{on}$ (1/Ms) | K$_{diss}$ (1/s) |
|---|---|---|---|---|
| 1036 | PSMA-VHH; CB01A01R3, CD3.23 | 12.87 | 9.87E+04 | 1.27E−03 |
| 1037 | PSMA-VHH; P01C01R3, CD3.23 | Weak binding | | |
| 1038 | PSMA-VHH; CB01H01R3, CD3.23 | 0.79 | 1.10E+05 | 8.70E−05 |
| 1039 | PSMA-VHH; CB01B02R3, CD3.23 | 1.15 | 1.78E+05 | 2.05E−04 |
| 1040 | PSMA-VHH; P01H01R3, CD3.23 | No binding | | |
| 1041 | PSMA-VHH; P01E02R3, CD3.23 | 0.60 | 2.61E+05 | 1.56E−04 |
| 1042 | PSMA-VHH; P01G03R3, CD3.23 | 55.74 | 9.67E+03 | 5.39E−04 | uTCEs having the amino acid sequences of SEQ ID NOs 1038 (the unmasked TCE, or uTCE, of AC2591), 1039, and 1041 had sub- to single digit nM affinity.

Epitope competition assays were performed next. An Octet AHC biosensor was loaded with human PSMA-Fc, followed by the uTCE of AC2591. The complex of human PSMA-Fc and the uTCE of AC2591 was then dipped into uTCEs having the amino acid sequences of SEQ ID Nos 1036, 1039 and 1041. The results of the competition assay indicated that uTCEs having the amino acid sequences of SEQ ID NOs 1036, 1038 (the uTCE of AC2591), and 1039 have an overlapping epitope, while the uTCE having the amino acid sequence of SEQ ID NO 1042 binds to a different epitope than the uTCE of AC2591.

Binding affinities and melting temperatures were determined for PSMA.5 and other variants. As shown in Table 12 below, the PSMA PTE removal clones possess binding affinities closer to PSMA.2. All PTE removal clones were combined with CD3.23. All clones were screened as unmasked paTCE (uTCE)

TABLE 12

Binding affinities and melting temperatures of select PSMA antibodies

| uTCE | N-term | N_ELNN Length (number of residues) | RS | aPSMA Domain | Linker Length (number of residues) | aCD3 Domain | Order | RS | C_ELNN Length (number of residues) | K$_D$ PSMA, Octet, (nM) | TM |
|---|---|---|---|---|---|---|---|---|---|---|---|
| uTCE of AC2591 | ASHHHHHH (SEQ ID NO: 9361) | 288 | 2295 | PSMA.2 | 9 | CD3.23 | VL-VH | 2295 | 576 | 1±0.6 | 64.3 |
| uTCE of AC3092 | | 288 | 2295 | PSMA.5 | 9 | CD3.23 | VL-VH | 2295 | 576 | 3.9±1.8 | 64.6 |
| uTCE of AC3354 | ASHHHHHH (SEQ ID NO: 9361) | 144 | 2295 | PSMA.5 | 15 | CD3.23 | VL-VH | 2295 | 144 | 3.5±0.07 | 64.74 |

TABLE 12-continued

Binding affinities and melting temperatures of select PSMA antibodies

| uTCE | N-term | N_ELNN Length (number of residues) | RS | aPSMA Domain | Linker Length (number of residues) | aCD3 Domain | Order | RS | C_ELNN Length (number of residues) | $K_D$ PSMA, Octet, (nM) | TM |
|---|---|---|---|---|---|---|---|---|---|---|---|
| uTCE of AC3353 | ASHHHHHH (SEQ ID NO: 9361) | 144 | 2295 | PSMA.5 | 5 | CD3.23 | VL-VH | 2295 | 144 | 2.1±0.2 | 64.05 |
| uTCE of AC3356 | ASHHHHHH (SEQ ID NO: 9361) | 144 | 2295 | PSMA.5 | 9 | CD3.23 | VH-VL | 2295 | 144 | 2.4±0.1 | 63.71 |
| uTCE of AC3342 | ASHHHHHH (SEQ ID NO: 9361) | 144 | 2295 | PSMA.132 | 9 | CD3.23 | VL-VH | 2295 | 144 | 5.6±1.8 | 63.51 |
| uTCE of AC3329 | ASHHHHHH (SEQ ID NO: 9361) | 144 | 2295 | PSMA.119 | 9 | CD3.23 | VL-VH | 2295 | 144 | 3.2±1.8 | 64.45 |
| uTCE of AC3185 | ASHHHHHH (SEQ ID NO: 9361) | 144 | 2295 | PSMA.37 | 5 | CD3.23 | VL-VH | 2295 | 144 | 1.1±0.1 | 62.57 |
| uTCE of AC3265 | ASHHHHHH (SEQ ID NO: 9361) | 144 | 2295 | PSMA.55 | 9 | CD3.23 | VL-VH | 2295 | 144 | 2.7±0.9 | 64.45 |

Binding affinity of select PSMA PTE variants was tested by Octet. Human PSMA-Fc fusions were used and measured with 300 nM, 100 nM, 33 nM, and 3.6 nM of PSMA-uTCE. PSMA.55, PSMA.119 and PSMA.132 are single point mutants of PTE removal variants which show maintained binding and stability. PSMA.2 is a camelid VHH. PSMA.5 and PSMA.6 are humanized VHH from PSMA. The Y to F mutation in PSMA.6 was determined to eliminate PTE in an assay. The binding affinities are shown below in Table 13.

TABLE 13

Binding affinities of select PSMA antibodies

| Molecule | $K_D$ (nM) | $k_{on}$ (1/Ms) | $k_{off}$ (1/s) |
|---|---|---|---|
| PSMA.55 | 2.7 ± 0.9 | 1.04E+05 | 2.80E−04 |
| PSMA.119 | 3.2 ± 1.8 | 8.00E+04 | 2.48E−04 |
| PSMA.132 | 5.6 ± 1.8 | 8.66E+04 | 4.79E−04 |
| PSMA.2 | 1 ± 0.6 | 1.25E+05 | 1.22E−04 |
| PSMA.5 | 3.9 ± 1.8 | 7.25E+04 | 2.73E−04 |
| PSMA.6 | 2.3 ± 1 | 9.63E+04 | 2.35E−04 |

The binding affinity of PSMA antibodies was tested in the paTCE format using different linker lengths between the PSMA antibody and CD3 antibody to determine the effect of linker length on binding affinity. A 5 amino acid (5mer) and 15 amino acid (15mer) linker was tested. A domain swapped CD3 was also tested (VH-VL orientation and VL-VH orientation from N-terminus to C-terminus). The results, shown below in Table 14, show that linker length and domain swapping did not impact binding. PSMA.37 also had similar binding affinity to PSMA.2.

TABLE 14

Binding affinities of select PSMA antibodies with alternative linker lengths and CD3 domain swapping

| Molecule | $K_D$ (nM) | $k_{on}$ (1/Ms) | $k_{off}$ (1/s) |
|---|---|---|---|
| PSMA.5 (5 mer) | 2.1 ± 0.2 | 1.1E+05 | 2.2E−04 |
| PSMA.5 (15 mer) | 3.5 ± 0.07 | 7.7E+04 | 2.7E−04 |
| PSMA.5 (domain swap) | 2.4 ± 0.1 | 7.6E+04 | 1.8E−04 |
| PSMA.37 (scFv) | 1.1 ± 0.1 | 1.2E+05 | 1.4E−04 |
| PSMA.2 | 1 ± 0.6 | 1.2E+05 | 1.2E−04 |
| PSMA.5 | 3.9 ± 1.8 | 7.2E+04 | 2.7E−04 |
| PSMA.6 | 2.3 ± 1 | 9.6E+04 | 2.4E−04 |

Figure 10:
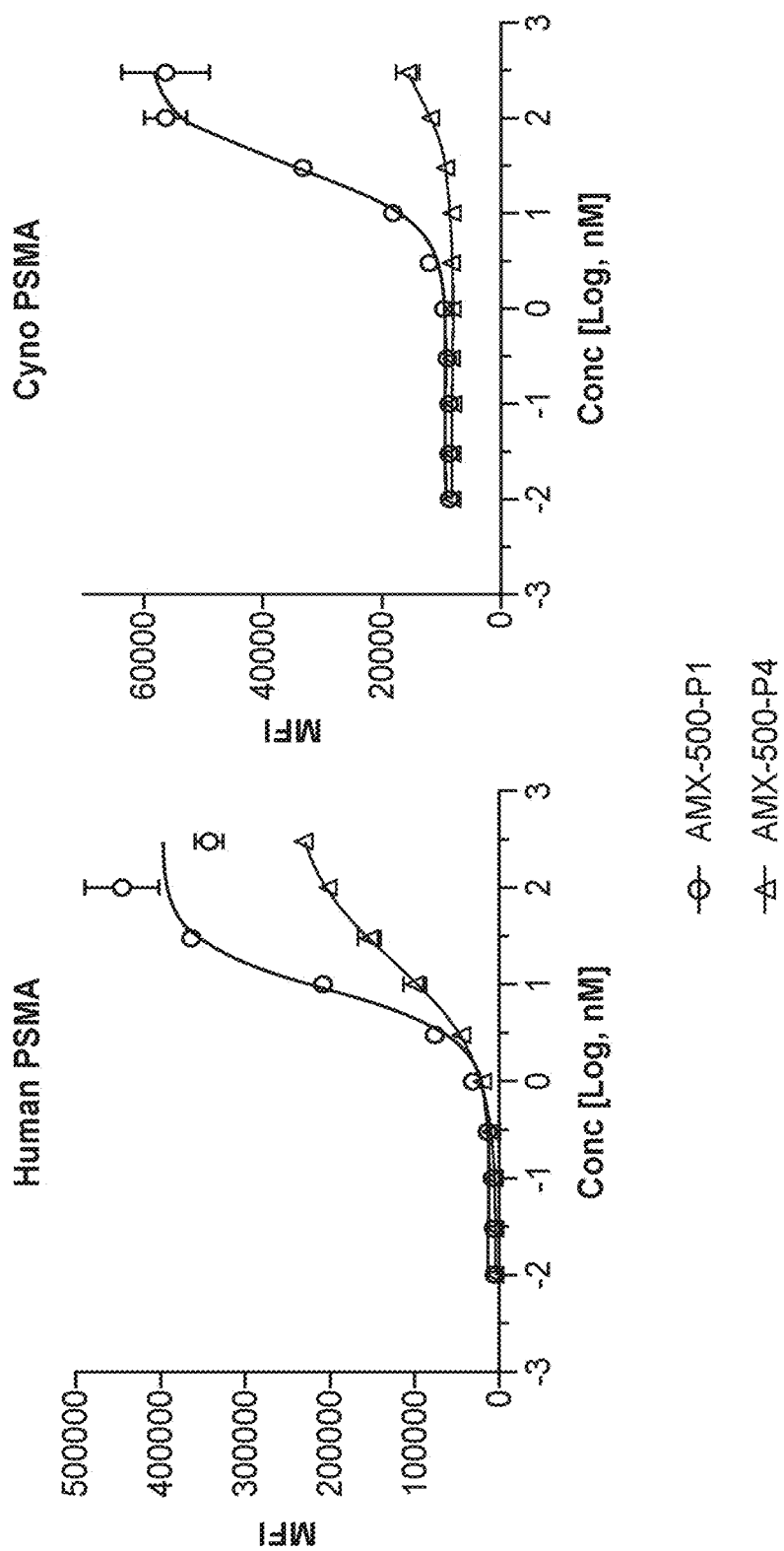
FIG. 10 depicts graphs of PSMA-transfected CHO cell binding activity against human PSMA or cyno PSMA between AC3092 (AMX-500-P1) and AC3896 (AMX-500-P4; also referred to here as simply AMX-500). Surface binding was detected with a labeled secondary antibody specific for the anti-CD3 scFv.

Variants of the PSMA-binding unmasked PSMA-binding paTCE (uTCE) were tested for binding affinity, each variant employing a different PSMA antibody/CD3 antibody combination. The binding affinities to both human and cyno PSMA and human and cyno CD3 epsilon were determined. The values are reported below in Table 15 and Table 16. The melting temperature for several of these variants was also determined and reported below in Table 17. Cell binding data comparing the uTCEs from AC3092 (AMX-500-P1) and AC3896 (AMX-500-P4; also referred to here as simply AMX-500) is shown in FIG. 10. The EC50 values are reported below in Table 18.

TABLE 15

PSMA binding affinities of select PSMA-binding uTCEs

| AC | RS | aPSMA | aCD3 | RS | Octet, huPSMA $K_D$(nM) | Octet, cyPSMA $K_D$(nM) | Biacore, huPSMA $K_D$(nM) | Biacore, cyPSMA $K_D$(nM) |
|---|---|---|---|---|---|---|---|---|
| uTCE from AC3092 | 2295 | PSMA.5 | CD3.23 | 2295 | 4.5 | 41.1 | ND | ND |
| uTCE from AC3445 | 2295 | PSMA.119 | CD3.23 | 2295 | 6.2 | 47.5 | ND | ND |
| uTCE from AC3896 | 3213 | PSMA.350 | CD3.228 | 3213 | 12.1 | 201 | 11.7 | 230 |
| uTCE from AC3928 | 3213 | PSMA.350 | CD3.23 | 3213 | 13.2 | 198 | 19 | 354 |
| uTCE from AC3934 | 3213 | PSMA.262 | CD3.228 | 3213 | 1.6 | 13.1 | 0.5 | 13 |

ND = Not determined.

TABLE 16

CD3 binding affinities of select PSMA-binding uTCEs

| AC | RS | aPSMA | aCD3 | RS | Octet, huCD3e $K_D$(nM) | Octet, cyCD3e $K_D$(nM) | Biacore, huCD3e $K_D$(nM) | Biacore, cyCD3e $K_D$(nM) |
|---|---|---|---|---|---|---|---|---|
| uTCE from AC3092 | 2295 | PSMA.5 | CD3.23 | 2295 | 71.9 | 64.6 | ND | ND |
| uTCE from AC3445 | 2295 | PSMA.119 | CD3.23 | 2295 | 34.8 | 40 | ND | ND |
| uTCE from AC3896 | 3213 | PSMA.350 | CD3.228 | 3213 | 33.2 | 38.8 | 12.8 | 13.7 |
| uTCE from AC3928 | 3213 | PSMA.350 | CD3.23 | 3213 | 43 | 44.9 | 27.3 | 26.6 |
| uTCE from AC3934 | 3213 | PSMA.262 | CD3.228 | 3213 | 26.6 | 33.7 | 9.83 | 10.39 |

ND = Not Determined

TABLE 17

Melting Temperatures

| AC Num | Description | Tm (° C.) | SD |
|---|---|---|---|
| AC2330 | paTCE control for target other than PSMA | 67.71 | 0.0001 |
| AC3896 | AMX500-P4 | 70.92 | 0.0857 |
| AC3896 | AMX500-P4 | 70.53 | 0.0001 |
| AC3928 | AMX500-P6 | 68.01 | 0.1483 |
| AC3928 | AMX500-P6 | 67.61 | 0.0855 |
| AC3934 | AMX500-P7 | 70.97 | 0.0001 |
| AC3934 | AMX500-P7 | 70.43 | 0.0855 |

TABLE 18

CHO cell binding EC50 values (nM) of select PSMA-binding paTCEs

| Cell Line | AMX-500-P1 (nM) | AMX-500-P4 (nM) |
|---|---|---|
| Hu PSMA CHO | 9.063 | 17.42 |
| Cyno PSMA CHO | 28.77 | ND |

The molecule designated AC3896 (AMX-500) was chosen for further characterization.

Unmasked PSMA-binding paTCE (uTCE) leads were screened via BLI (Biolayer Interferometry) or SPR (Surface Plasmon Resonance). The uTCE leads were determined to have a $K_D$ in a range of 1 nM to 100 nM against human PSMA and a $K_D$ in a range of 1 nM to 1000 nM against cynomolgus monkey PSMA. The masked PSMA-binding paTCE AMX-500 was determined to have a $K_D$ of about 546 nM and about 2900 nM against human and cynomolgus monkey PSMA, respectively. The metabolite AMX-500(1x-N) of AMX-500 has a $K_D$ of about 230 nM and about 2400 nM against human and cynomolgus monkey PSMA, respectively. The AMX-500(1x-C) metabolite AMX-500 has a $K_D$ of about 353 nM and about 2900 nM against human and cynomolgus monkey PSMA, respectively. Fully unmasked AMX-500(uTCE) has a $K_D$ of about 44 nM and about 410 nM against human and cynomolgus monkey PSMA, respectively. The values are reported below in Table 19 for PSMA and Table 20 for CD3.

TABLE 19

Binding kinetics of AMX-500 and its metabolites for human and cynomolgus monkey PSMA

| | Human PSMA | | | Cyno PSMA | | |
|---|---|---|---|---|---|---|
| Compound | $K_D$ (nM) | ka (M−1 s−1) | kd (s−1) | $K_D$ (nM) | ka (M−1 s−1) | kd (s−1) |
| AMX-500 | 546 ± 29 | (2.3 ± 0.09)E4 | (1.2 ± 0.03)E−2 | 2900 ± 700 | (1.4 ± 0.5)E4 | (4.0 ± 0.5)E−2 |
| AMX-500 (1x-N) | 230 ± 18 | (5.0 ± 0.2)E4 | (1.2 ± 0.05)E−2 | 2400 ± 300 | (1.6 ± 0.2)E4 | (3.9 ± 0.6)E−2 |
| AMX-500 (1x-C) | 353 ± 11 | (3.5 ± 0.1)E4 | (1.2 ± 0.03)E−2 | 2900 ± 800 | (1.4 ± 0.3)E4 | (3.9 ± 0.09)E−2 |
| AMX-500 (uTCE) | 44 ± 1 | (2.7 ± 0.06)E5 | (1.2 ± 0.008)E−2 | 410.1 ± 0.8 | (1.0 ± 0.01)E5 | (4.3 ± 0.06)E−2 |

TABLE 20

Binding kinetics of AMX-500 and its metabolites for human and cynomolgus monkey CD3

| | Human CD3 | | | Cyno CD3 | | |
|---|---|---|---|---|---|---|
| Compound | $K_D$ (nM) | ka (M−1 s−1) | kd (s−1) | $K_D$ (nM) | ka (M−1 s−1) | kd (s−1) |
| AMX-500 | 90 ± 3 | (1.7 ± 0.09)E6 | 0.2 ± 0.004 | 70 ± 2 | (2.0 ± 0.07)E6 | 0.1 ± 0.03 |
| AMX-500 (1x-N) | 46.3 ± 0.3 | (2.8 ± 0.07)E6 | 0.1 ± 0.002 | 38 ± 1 | (2.9 ± 0.08)E6 | 0.1 ± 0.002 |
| AMX-500 (1x-C) | 34.4 ± 0.6 | (3.2 ± 0.08)E6 | 0.1 ± 0.002 | 26.7 ± 0.7 | (3.4 ± 0.09)E6 | 0.1 ± 0.0006 |
| AMX-500 (uTCE) | 28 ± 2 | (4.0 ± 0.2)E6 | 0.1 ± 0.01 | 26 ± 3 | (5 ± 2)E6 | 0.1 ± 0.05 |

The binding kinetic data recited above in Table 19 demonstrate that AMX-500, comprising both masking polypeptides, has a higher $K_D$ for PSMA than the unmasked AMX-500(uTCE). Similarly, the AMX-500 metabolites each have a higher $K_D$ for PSMA than the unmasked AMX-500. The AMX-500 1x-N metabolite lacks the masking polypeptide linked to the CD3 antigen binding domain and the AMX-500 1x-C metabolite lacks the masking polypeptide linked to the PSMA antigen binding domain. Table 19 further demonstrates that the PSMA antigen binding domain does not cross react to cyno PSMA. Table 20 demonstrates that the CD3 antigen binding domain binds to human and cyno CD3 with a similar $K_D$.

Example 5. Design of Barcoded ELNNs by Minimal Mutations in ELNNs

ELNN polypeptide sequences can optionally contain a barcode fragment releasable from the polypeptide upon digestion by a protease. A barcode fragment may be, e.g., (1) a portion of the ELNN that includes at least part of a (non-recurring, non-overlapping) sequence motif that occurs only once within the ELNN; and (2) differs in sequence and molecular weight from all other peptide fragments that are releasable from the polypeptide containing them (e.g., a paTCE) upon complete digestion of the polypeptide by a protease. The term "barcode fragment" ("barcode," or "barcode sequence") can refer to either the portion of the ELNN cleavably fused within the polypeptide, or the resulting peptide fragment released from the polypeptide. Previous barcode sequences (see, e.g., PCT International Patent Application No. WO2021/263058, the entire content of which is incorporated herein by reference) were designed with the intention of creating unique barcode polypeptide sequences with as minimal mutations in the original ELNN sequence as possible. However, such barcode sequences required 1000 µg/mL of Glu-C and an overnight digest to release them from peptides containing them, such as paTCEs. The barcode polypeptide sequences described in this Example were designed and tested to perform against a second criteria: That the barcode polypeptide is releasable from the ELNN polypeptide rapidly (in approximately two hours vs an overnight digest) by a low concentration of protease (less than 30 µg/mL protease); in addition to the criteria of introducing the fewest mutations to the original ELNN sequence as possible.

In order to determine which peptide sequences were most favorably cleaved by Glu-C protease in a two-hour protease digest, a library of approximately 1000 peptides was constructed with each peptide containing a different cleavage sequence for the protease Glu-C. Equimolar concentrations of these Glu-C site-containing peptides were tested in a 2-hour digest against a range of Glu-C protease concentrations from 0.05 µg/mL to 1000 µg/mL of protease. After digestion the peptides were analyzed by liquid chromatography mass spectrometry. The Glu-C cleavage site sequences that were cleaved by the lowest concentrations of protease were cataloged. From this list of the fastest sequences, a select few were selected that were most compatible with ELNN polypeptides. These sequences were then implemented to flank new "Generation 2" barcode sequences.

A selection of Generation 2 barcode sequences was cloned into ELNN sequences and their performance as barcode peptides was tested by Glu-C digestion and subsequent liquid chromatography mass spectrometry analyses. Successful barcode sequences from this experiment had 3 criteria: 1.) The barcode peptide was fully releasable from the ELNN polypeptide in a 2-hour digest by a concentration of 40 µg/mL of protease. 2.) The barcode peptide was not cleaved or otherwise degraded by much higher concentrations of protease, and 3.) The barcode peptide that met conditions 1 and 2 contained the fewest mutations from the original ELNN polypeptide sequence. Below are examples of successful Generation 2 barcode sequences according to the criteria of the aforementioned selection process:

TABLE 21

Exemplary Generation 2 Barcode Sequences

| Gen 2 Barcode 01 | SGPE.SGPGTGTSATPE.SGPG (SEQ ID NO: 9362) |
|---|---|
| Gen 2 Barcode 02 | ATPE.SGPGSGPGTSE.SATP (SEQ ID NO: 9363) |
| Gen 2 Barcode 03 | ATPE.SGPGTTPGTTPE.SGPG (SEQ ID NO: 9364) |
| Gen 2 Barcode 04 | ATPE.SGPGTPPTSTPE.SGPG (SEQ ID NO: 9365) |
| Gen 2 Barcode 05 | ATPE.SGPGTSPSATPE.SGPG (SEQ ID NO: 9366) |
| Gen 2 Barcode 06 | ATPE.SGPGTGSAGTPE.SGPG (SEQ ID NO: 9367) |
| Gen 2 Barcode 07 | ATPE.SGPGTGGAGTPE.SGPG (SEQ ID NO: 9368) |
| Gen 2 Barcode 08 | ATPE.SGPGTSPGATPE.SGPG (SEQ ID NO: 9369) |
| Gen 2 Barcode 09 | GTPE.SGPGTSGSGTPE.SGPG (SEQ ID NO: 9370) |
| Gen 2 Barcode 10 | GTPE.SGPGTSSASTPE.SGPG (SEQ ID NO: 9371) |
| Gen 2 Barcode 11 | GTPE.SGPGTGAGTTPE.SGPG (SEQ ID NO: 9372) |
| Gen 2 Barcode 12 | GTPE.SGPGTGSTSTPE.SGPG (SEQ ID NO: 9373) |
| Gen 2 Barcode 13 | GTPE.TPGSEPATSGSE.TGTP (SEQ ID NO: 9374) |
| Gen 2 Barcode 14 | GTPE.GSAPGTSTEPSE.SATP (SEQ ID NO: 9375) |
| Gen 2 Barcode 15 | ATPE.SGPGTAGSGTPE.SGPG (SEQ ID NO: 9376) |
| Gen 2 Barcode 16 | ATPE.SGPGTSSGGTPE.SGPG (SEQ ID NO: 9377) |
| Gen 2 Barcode 17 | ATPE.SGPGTAGPATPE.SGPG (SEQ ID NO: 9378) |
| Gen 2 Barcode 18 | ATPE.SGPGTPGTGTPE.SGPG (SEQ ID NO: 9379) |

TABLE 21-continued

Exemplary Generation 2 Barcode Sequences

| Gen 2 Barcode 19 | TTPE.SGPGTGGPTTPE.SGPG (SEQ ID NO: 9380) |
|---|---|
| Gen 2 Barcode 20 | STPE.SGPGTGSGSTPE.SGPG (SEQ ID NO: 9381) |

Example 6. Improved Anti-CD3 Binding Sequences

CD3 scFv paTCE arm optimization was conducted to reduce molecule immunogenicity and improve stability, while maintaining binding affinity with CD3 close to the affinity observed for the CD3.23 parental molecule.

To achieve this, Pool 1 was created, which included 74 paTCE molecules, each containing PSMA.5 and one of the 74 CD3.23 mutation variants. The amino acid sequences of each of the 74 CD3.23 mutation variants are provided in Table 23a. Single mutations were chosen based on analyses including CD3.23 PTE score analysis (using internal PTE algorithm v12) and structural analysis. Structural considerations included: possible contact disruption, anticipated steric clashes, side chain charge maintenance and possible pockets filling. Stability and affinity of the individually expressed molecules in the form of crude lysate was evaluated by Octet (ForteBio).

Based on the results of the Pool 1 screening, mutations that did not disrupt paTCE molecule affinity and stability were taken further to evaluate as combinations in Pool 2. Pool 2 consisted of paTCE molecules each containing PSMA.262 and one of 64 CD3.23 mutation combination variants. The amino acid sequences of each of the 64 CD3.23 mutation combination variants are provided in Table 23b. Stability and affinity of the individually expressed molecules in the form of crude lysate was evaluated by Octet. The four most stable paTCE molecules from Pool 2 were additionally expressed in a larger volume (2.5 L) and purified. The binding of these anti-CD3 molecules (CD3.227, CD3.228, CD3.229 and CD3.230) to human and cynomolgus CD3 was measured by Octet and the $T_m$ was measured by Differential Scanning Fluorimetry. All variants were paired with PSMA.262 except for CD3.23 which was paired with PSMA.5. Values are reported below in Table 22.

TABLE 22

Binding affinities, melting temperatures, and PTE values for select CD3 antibodies

| CD3 Antibody | $K_D$, huCD3e-Fc | kon (1/Ms), huCD3e-Fc | kdiss (1/s), huCD3e-Fc | $K_D$, cyCD3e | kon (1/Ms), cyCD3e-Fc | kdiss (1/s), cyCD3e-Fc | PTE score (v22) | Tm |
|---|---|---|---|---|---|---|---|---|
| CD3.227 | 57 nM | 3.42E+05 | 1.96E−02 | 80 nM | 3.15E+05 | 2.53E−02 | 10 | 63.71 |
| CD3.228 | 69 nM | 3.17E+05 | 2.17E−02 | 80 nM | 3.34E+05 | 2.66E−02 | 10 | 64.45 |
| CD3.229 | 162 nM | 3.21E+05 | 5.20E−02 | 193 nM | 3.17E+05 | 6.11E−02 | 15 | 63.46 |
| CD3.230 | 195 nM | 3.25E+05 | 6.33E−02 | 216 nM | 3.36E+05 | 7.26E−02 | 15 | 63.71 |
| CD3.23 | 131 nM | 2.20E+05 | 2.89E−02 | 130 nM | 2.40E+05 | 3.12E−02 | 73 | 62.62 |

Figures 6A, 6B:
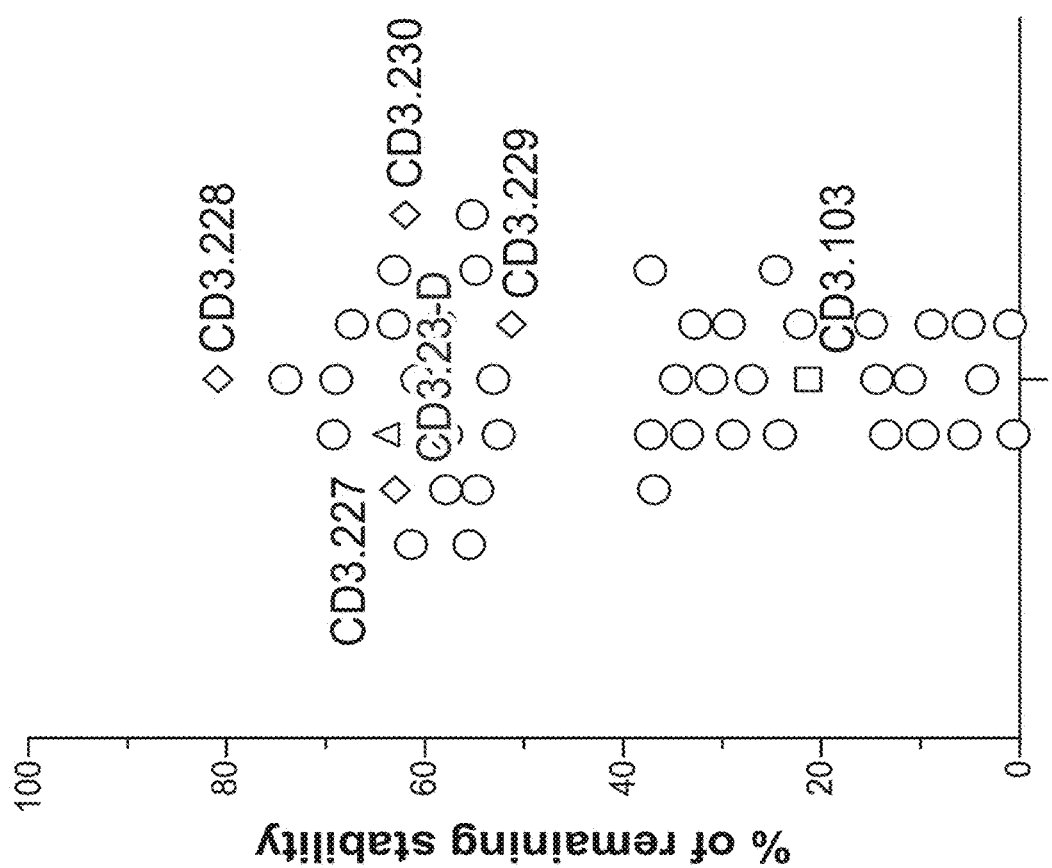
FIG. 6A depicts PTE score evaluations using internal PTE algorithm v22 for anti-CD3 pool2 antibodies.
FIG. 6B depicts a percent of remaining antibodies following a thermal stability assay.

Based on these data that included additional PTE score evaluation using internal PTE algorithm v22 (FIG. 6A), and an additional thermal stability evaluation for which the antibodies were heated at 60° C. for 5 min (FIG. 6B), CD3.228 scFv was chosen over the other leads in Table 22.

An alignment of parental CD3.9 and CD3.23 and selected CD3.228 VL and VH molecules with differences highlighted is provided below. CD3.9 is a humanized version of the SP34 monoclonal mouse antibody. CD3.23 has 8 mutations compared to CD3.9, and has an estimated 2-4 fold lower affinity vs CD3.9 based on ELISA, Octet, and cell binding data. CD3.228 has 8 mutations compared to CD3.23 and 16 mutations compared to CD3.9. CD3.228 has increased stability and lower immunogenicity risk compared to CD3.23. Mutation Numbering is According to Kabat Database.

```
>CD3.9_VL
                                                     (SEQ ID NO: 359)
ELVVTQEPSLTVSPGGTVTLTCRSSTGAVTTSNYANWVQQKPGQAPRGLIGGTNKRA

PGTPARFSGSLLGGKAALTLSGVQPEDEAEYYCALWYSNLWVFGGGTKLTVL

>CD3.23_VL
                                                     (SEQ ID NO: 361)
ELVVTQEPSLTVSPGGTVTLTCRSSNGAVTSSNYANWVQQKPGQAPRGLIGGTNKRA

PGTPARFSGSLLGGKAALTLSGVQPEDEAVYYCALWYPNLWVFGGGTKLTVL

>CD3.228_VL
                                                     (SEQ ID NO: 361)
ELVVTQEPSLTVSPGGTVTLTCRSSNGAVTSSNYANWVQQKPGQAPRGLIGGTNKRA

PGTPARFSGSLLGGKAALTLSGVQPEDEAVYYCALWYPNLWVFGGGTKLTVL

CD3.9_VL
                                                    (SEQ ID NO: 9382)
ELVVTQEPSLTVSPGGTVTLTCRSSTGAVTTSNYANWVQQKPGQAPRGLIGGTNKRAPGT

CD3.23_VL
                                                    (SEQ ID NO: 9383)
ELVVTQEPSLTVSPGGTVTLTCRSSNGAVTSSNYANWVQQKPGQAPRGLIGGTNKRAPGT

CD3.228_VL
                                                    (SEQ ID NO: 9383)
ELVVTQEPSLTVSPGGTVTLTCRSSNGAVTSSNYANWVQQKPGQAPRGLIGGTNKRAPGT

***********************.****.*****************************

CD3.9_VL
                                                    (SEQ ID NO: 9384)
PARFSGSLLGGKAALTLSGVQPEDEAEYYCALWYSNLWVFGGGTKLTVL

CD3.23_VL
                                                    (SEQ ID NO: 9385)
PARFSGSLLGGKAALTLSGVQPEDEAVYYCALWYPNLWVFGGGTKLTVL

CD3.228_VL
                                                    (SEQ ID NO: 9385)
PARFSGSLLGGKAALTLSGVQPEDEAVYYCALWYPNLWVFGGGTKLTVL

*************************.*******.**************

T27N, T29S, E85V, S93P: differences with CD3.9

>CD3.9_VH
                                                     (SEQ ID NO: 309)
EVQLLESGGGLVQPGGSLKLSCAASGFTFNTYAMNWVRQAPGKGLEWVARIRSKYNN

YATYYADSVKDRFTISRDDSKNTAYLQMNNLKTEDTAVYYCVRHGNFGNSYVSWFAY

WGQGTLVTVSS

>CD3.23_VH
                                                     (SEQ ID NO: 102)
EVQLLESGGGIVQPGGSLKLSCAASGFTFNTYAMNWVRQAPGKGLEWVARIRSKYNN

YATYYADSVKDRFTISRDDSKNTVYLQMNNLKTEDTAVYYCVRHENFGNSYVSWFAH

WGQGTLVTVSS
```

```
-continued
>CD3.228_VH
                                                     (SEQ ID NO: 311)
EVQLVESGGGIVQPGGSLRLSCAASGFTFSTYAMNWVRQAPGKGLEWVGRIRTKRNN

YATYYADSVKGRFTISRDDSKNTVYLQMNSLKTEDTAVYYCVRHENFGNSYVSWFAH

WGQGTLVTVSS

CD3.9_VH
                                                     (SEQ ID NO: 9386)
EVQLLESGGGLVQPGGSLKLSCAASGFTFNTYAMNWVRQAPGKGLEWVARIRSKYNNYAT

CD3.23_VH
                                                     (SEQ ID NO: 9387)
EVQLLESGGGIVQPGGSLKLSCAASGFTFNTYAMNWVRQAPGKGLEWVARIRSKYNNYAT

CD3.228_VH
                                                     (SEQ ID NO: 9388)
EVQLVESGGGIVQPGGSLRLSCAASGFTFSTYAMNWVRQAPGKGLEWVGRIRTKRNNYAT
****:******.*******.****************:.***.*.*****

CD3.9_VH
                                                     (SEQ ID NO: 9389)
YYADSVKDRFTISRDDSKNTAYLQMNNLKTEDTAVYYCVRHGNFGNSYVSWFAYWGQGTL

CD3.23_VH
                                                     (SEQ ID NO: 9390)
YYADSVKDRFTISRDDSKNTVYLQMNNLKTEDTAVYYCVRHENFGNSYVSWFAHWGQGTL

CD3.228_VH
                                                     (SEQ ID NO: 9391)
YYADSVKGRFTISRDDSKNTVYLQMNSLKTEDTAVYYCVRHENFGNSYVSWFAHWGQGTL

*******.************ *****.************* **********:******

CD3.9_VH
                                                     (SEQ ID NO: 574)
VTVSS

CD3.23_VH
                                                     (SEQ ID NO: 574)
VTVSS

CD3.228_VH
                                                     (SEQ ID NO: 574)
VTVSS
*****
```

TABLE 23a

Pool 1 CD3.23 Mutation Variants

| AC | VL sequence | VL SEQ ID NO: | VH sequence | VH SEQ ID NO: |
|---|---|---|---|---|
| AC3364 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 834 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 835 |
| AC3366 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 836 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 837 |
| AC3367 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 838 | EVQLLESGGGIVQPGGSLKLSC AASGFTFNTYAMNWVRQAPG KGLEDVARIRSKYNNYATYYAD SVKDRFTISRDDSKNTVYLQMN NLKTEDTAVYYCVRHENFGNS YVSWFAHWGQGTLVTVSS | 839 |

TABLE 23a-continued

| | | | | |
|---|---|---|---|---|
| AC3368 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 840 | EVQLLESGGGIVQPGGSLKLSC AASGFTFNTYAMNWVRQAPG KGLEEVARIRSKYNNYATYYAD SVKDRFTISRDDSKNTVYLQMN NLKTEDTAVYYCVRHENFGNS YVSWFAHWGQGTLVTVSS | 841 |
| AC3369 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 842 | EVQLLESGGGIVQPGGSLKLSC AASGFTFNTYAMNWVRQAPG KGLEWAARIRSKYNNYATYYA DSVKDRFTISRDDSKNTVYLQM NNLKTEDTAVYYCVRHENFGN SYVSWFAHWGQGTLVTVSS | 843 |
| AC3370 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 844 | EVQLLESGGGIVQPGGSLKLSC AASGFTFNTYAMNWVRQAPG KGLEWEARIRSKYNNYATYYA DSVKDRFTISRDDSKNTVYLQM NNLKTEDTAVYYCVRHENFGN SYVSWFAHWGQGTLVTVSS | 845 |
| AC3371 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 846 | EVQLLESGGGIVQPGGSLKLSC AASGFTFNTYAMNWVRQAPG KGLEWGARIRSKYNNYATYYA DSVKDRFTISRDDSKNTVYLQM NNLKTEDTAVYYCVRHENFGN SYVSWFAHWGQGTLVTVSS | 847 |
| AC3372 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 848 | EVQLLESGGGIVQPGGSLKLSC AASGFTFNTYAMNWVRQAPG KGLEWSARIRSKYNNYATYYA DSVKDRFTISRDDSKNTVYLQM NNLKTEDTAVYYCVRHENFGN SYVSWFAHWGQGTLVTVSS | 849 |
| AC3373 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 850 | EVQLLESGGGIVQPGGSLKLSC AASGFTFNTYAMNWVRQAPG KGLEWTARIRSKYNNYATYYA DSVKDRFTISRDDSKNTVYLQM NNLKTEDTAVYYCVRHENFGN SYVSWFAHWGQGTLVTVSS | 851 |
| AC3374 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 852 | EVQLLESGGGIVQPGGSLKLSC AASGFTFNTYAMNWVRQAPG KGLEWWARIRSKYNNYATYYA DSVKDRFTISRDDSKNTVYLQM NNLKTEDTAVYYCVRHENFGN SYVSWFAHWGQGTLVTVSS | 853 |
| AC3375 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 854 | EVQLLESGGGIVQPGGSLKLSC AASGFTFNTYAMNWVRQAPG KGLEWVDRIRSKYNNYATYYA DSVKDRFTISRDDSKNTVYLQM NNLKTEDTAVYYCVRHENFGN SYVSWFAHWGQGTLVTVSS | 855 |
| AC3376 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 856 | EVQLLESGGGIVQPGGSLKLSC AASGFTFNTYAMNWVRQAPG KGLEWVERIRSKYNNYATYYA DSVKDRFTISRDDSKNTVYLQM NNLKTEDTAVYYCVRHENFGN SYVSWFAHWGQGTLVTVSS | 857 |
| AC3377 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 858 | EVQLLESGGGIVQPGGSLKLSC AASGFTFNTYAMNWVRQAPG KGLEWVGRIRSKYNNYATYYA DSVKDRFTISRDDSKNTVYLQM NNLKTEDTAVYYCVRHENFGN SYVSWFAHWGQGTLVTVSS | 859 |
| AC3378 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 860 | EVQLLESGGGIVQPGGSLKLSC AASGFTFNTYAMNWVRQAPG KGLEWVAQIRSKYNNYATYYA DSVKDRFTISRDDSKNTVYLQM NNLKTEDTAVYYCVRHENFGN SYVSWFAHWGQGTLVTVSS | 861 |
| AC3379 | ELVVTQEPSLTVSPGGTVTL TCRSSNGAVTSSNYANWV QQKPGQAPRGLIGGTNKRA | 862 | EVQLLESGGGIVQPGGSLKLSC AASGFTFNTYAMNWVRQAPG KGLEWVAGIRSKYNNYATYYA | 863 |

| | | | | |
|---|---|---|---|---|
| | PGTPARFSGSLLGGKAALTL<br>SGVQPEDEAVYYCALWYPN<br>LWVFGGGTKLTVL | | DSVKDRFTISRDDSKNTVYLQM<br>NNLKTEDTAVYYCVRHENFGN<br>SYVSWFAHWGQGTLVTVSS | |
| AC3380 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 864 | EVQLLESGGGIVQPGGSLKLSC<br>AASGFTFNTYAMNWVRQAPG<br>KGLEWVAHIRSKYNNYATYYA<br>DSVKDRFTISRDDSKNTVYLQM<br>NNLKTEDTAVYYCVRHENFGN<br>SYVSWFAHWGQGTLVTVSS | 865 |
| AC3381 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 866 | EVQLLESGGGIVQPGGSLKLSC<br>AASGFTFNTYAMNWVRQAPG<br>KGLEWVAPIRSKYNNYATYYA<br>DSVKDRFTISRDDSKNTVYLQM<br>NNLKTEDTAVYYCVRHENFGN<br>SYVSWFAHWGQGTLVTVSS | 867 |
| AC3382 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 868 | EVQLLESGGGIVQPGGSLKLSC<br>AASGFTFNTYAMNWVRQAPG<br>KGLEWVAWIRSKYNNYATYYA<br>DSVKDRFTISRDDSKNTVYLQM<br>NNLKTEDTAVYYCVRHENFGN<br>SYVSWFAHWGQGTLVTVSS | 869 |
| AC3383 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 870 | EVQLLESGGGIVQPGGSLKLSC<br>AASGFTFNTYAMNWVRQAPG<br>KGLEWVARARSKYNNYATYYA<br>DSVKDRFTISRDDSKNTVYLQM<br>NNLKTEDTAVYYCVRHENFGN<br>SYVSWFAHWGQGTLVTVSS | 871 |
| AC3384 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 872 | EVQLLESGGGIVQPGGSLKLSC<br>AASGFTFNTYAMNWVRQAPG<br>KGLEWVARGRSKYNNYATYYA<br>DSVKDRFTISRDDSKNTVYLQM<br>NNLKTEDTAVYYCVRHENFGN<br>SYVSWFAHWGQGTLVTVSS | 873 |
| AC3385 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 874 | EVQLLESGGGIVQPGGSLKLSC<br>AASGFTFNTYAMNWVRQAPG<br>KGLEWVARTRSKYNNYATYYA<br>DSVKDRFTISRDDSKNTVYLQM<br>NNLKTEDTAVYYCVRHENFGN<br>SYVSWFAHWGQGTLVTVSS | 875 |
| AC3386 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 876 | EVQLLESGGGIVQPGGSLKLSC<br>AASGFTFNTYAMNWVRQAPG<br>KGLEWVARINSKYNNYATYYA<br>DSVKDRFTISRDDSKNTVYLQM<br>NNLKTEDTAVYYCVRHENFGN<br>SYVSWFAHWGQGTLVTVSS | 877 |
| AC3387 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 878 | EVQLLESGGGIVQPGGSLKLSC<br>AASGFTFNTYAMNWVRQAPG<br>KGLEWVARIDSKYNNYATYYA<br>DSVKDRFTISRDDSKNTVYLQM<br>NNLKTEDTAVYYCVRHENFGN<br>SYVSWFAHWGQGTLVTVSS | 879 |
| AC3388 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 880 | EVQLLESGGGIVQPGGSLKLSC<br>AASGFTFNTYAMNWVRQAPG<br>KGLEWVARIESKYNNYATYYA<br>DSVKDRFTISRDDSKNTVYLQM<br>NNLKTEDTAVYYCVRHENFGN<br>SYVSWFAHWGQGTLVTVSS | 881 |
| AC3389 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 882 | EVQLLESGGGIVQPGGSLKLSC<br>AASGFTFNTYAMNWVRQAPG<br>KGLEWVARIQSKYNNYATYYA<br>DSVKDRFTISRDDSKNTVYLQM<br>NNLKTEDTAVYYCVRHENFGN<br>SYVSWFAHWGQGTLVTVSS | 883 |
| AC3390 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 884 | EVQLLESGGGIVQPGGSLKLSC<br>AASGFTFNTYAMNWVRQAPG<br>KGLEWVARIGSKYNNYATYYA<br>DSVKDRFTISRDDSKNTVYLQM<br>NNLKTEDTAVYYCVRHENFGN<br>SYVSWFAHWGQGTLVTVSS | 885 |

TABLE 23a-continued

| | | | | |
|---|---|---|---|---|
| AC3391 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 886 | EVQLLESGGGIVQPGGSLKLSC AASGFTFNTYAMNWVRQAPG KGLEWVARIHSKYNNYATYYA DSVKDRFTISRDDSKNTVYLQM NNLKTEDTAVYYCVRHENFGN SYVSWFAHWGQGTLVTVSS | 887 |
| AC3392 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 888 | EVQLLESGGGIVQPGGSLKLSC AASGFTFNTYAMNWVRQAPG KGLEWVARIWSKYNNYATYYA DSVKDRFTISRDDSKNTVYLQM NNLKTEDTAVYYCVRHENFGN SYVSWFAHWGQGTLVTVSS | 889 |
| AC3393 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 890 | EVQLLESGGGIVQPGGSLKLSC AASGFTFNTYAMNWVRQAPG KGLEWVARIRNKYNNYATYYA DSVKDRFTISRDDSKNTVYLQM NNLKTEDTAVYYCVRHENFGN SYVSWFAHWGQGTLVTVSS | 891 |
| AC3394 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 892 | EVQLLESGGGIVQPGGSLKLSC AASGFTFNTYAMNWVRQAPG KGLEWVARIRDKYNNYATYYA DSVKDRFTISRDDSKNTVYLQM NNLKTEDTAVYYCVRHENFGN SYVSWFAHWGQGTLVTVSS | 893 |
| AC3395 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 894 | EVQLLESGGGIVQPGGSLKLSC AASGFTFNTYAMNWVRQAPG KGLEWVARIREKYNNYATYYA DSVKDRFTISRDDSKNTVYLQM NNLKTEDTAVYYCVRHENFGN SYVSWFAHWGQGTLVTVSS | 895 |
| AC3396 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 896 | EVQLLESGGGIVQPGGSLKLSC AASGFTFNTYAMNWVRQAPG KGLEWVARIRTKYNNYATYYA DSVKDRFTISRDDSKNTVYLQM NNLKTEDTAVYYCVRHENFGN SYVSWFAHWGQGTLVTVSS | 897 |
| AC3397 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 898 | EVQLLESGGGIVQPGGSLKLSC AASGFTFNTYAMNWVRQAPG KGLEWVARIRSPYNNYATYYA DSVKDRFTISRDDSKNTVYLQM NNLKTEDTAVYYCVRHENFGN SYVSWFAHWGQGTLVTVSS | 899 |
| AC3398 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 900 | EVQLLESGGGIVQPGGSLKLSC AASGFTFNTYAMNWVRQAPG KGLEWVARIRSKANNYATYYA DSVKDRFTISRDDSKNTVYLQM NNLKTEDTAVYYCVRHENFGN SYVSWFAHWGQGTLVTVSS | 901 |
| AC3399 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 902 | EVQLLESGGGIVQPGGSLKLSC AASGFTFNTYAMNWVRQAPG KGLEWVARIRSKRNNYATYYA DSVKDRFTISRDDSKNTVYLQM NNLKTEDTAVYYCVRHENFGN SYVSWFAHWGQGTLVTVSS | 903 |
| AC3400 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 904 | EVQLLESGGGIVQPGGSLKLSC AASGFTFNTYAMNWVRQAPG KGLEWVARIRSKGNNYATYYA DSVKDRFTISRDDSKNTVYLQM NNLKTEDTAVYYCVRHENFGN SYVSWFAHWGQGTLVTVSS | 905 |
| AC3401 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 906 | EVQLLESGGGIVQPGGSLKLSC AASGFTFNTYAMNWVRQAPG KGLEWVARIRSKKNNYATYYA DSVKDRFTISRDDSKNTVYLQM NNLKTEDTAVYYCVRHENFGN SYVSWFAHWGQGTLVTVSS | 907 |
| AC3402 | ELVVTQEPSLTVSPGGTVTL TCRSSNGAVTSSNYANWV | 908 | EVQLLESGGGIVQPGGSLKLSC AASGFTFNTYAMNWVRQAPG | 909 |

TABLE 23a-continued

| | | | | |
|---|---|---|---|---|
| | QQKPGQAPRGLIGGTNKRA<br>PGTPARFSGSLLGGKAALTL<br>SGVQPEDEAVYYCALWYPN<br>LWVFGGGTKLTVL | | KGLEWVARIRSKPNNYATYYA<br>DSVKDRFTISRDDSKNTVYLQM<br>NNLKTEDTAVYYCVRHENFGN<br>SYVSWFAHWGQGTLVTVSS | |
| AC3403 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 910 | EVQLLESGGGIVQPGGSLKLSC<br>AASGFTFNTYAMNWVRQAPG<br>KGLEWVARIRSKTNNYATYYA<br>DSVKDRFTISRDDSKNTVYLQM<br>NNLKTEDTAVYYCVRHENFGN<br>SYVSWFAHWGQGTLVTVSS | 911 |
| AC3404 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 912 | EVQLLESGGGIVQPGGSLKLSC<br>AASGFTFNTYAMNWVRQAPG<br>KGLEWVARIRSKWNNYATYYA<br>DSVKDRFTISRDDSKNTVYLQM<br>NNLKTEDTAVYYCVRHENFGN<br>SYVSWFAHWGQGTLVTVSS | 913 |
| AC3405 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 914 | EVQLLESGGGIVQPGGSLKLSC<br>AASGFTFNTYAMNWVRQAPG<br>KGLEWVARIRSKYDNYATYYA<br>DSVKDRFTISRDDSKNTVYLQM<br>NNLKTEDTAVYYCVRHENFGN<br>SYVSWFAHWGQGTLVTVSS | 915 |
| AC3406 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 916 | EVQLLESGGGIVQPGGSLKLSC<br>AASGFTFNTYAMNWVRQAPG<br>KGLEWVARIRSKYENYATYYA<br>DSVKDRFTISRDDSKNTVYLQM<br>NNLKTEDTAVYYCVRHENFGN<br>SYVSWFAHWGQGTLVTVSS | 917 |
| AC3407 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 918 | EVQLLESGGGIVQPGGSLKLSC<br>AASGFTFNTYAMNWVRQAPG<br>KGLEWVARIRSKYNDYATYYA<br>DSVKDRFTISRDDSKNTVYLQM<br>NNLKTEDTAVYYCVRHENFGN<br>SYVSWFAHWGQGTLVTVSS | 919 |
| AC3408 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 920 | EVQLLESGGGIVQPGGSLKLSC<br>AASGFTFNTYAMNWVRQAPG<br>KGLEWVARIRSKYNEYATYYA<br>DSVKDRFTISRDDSKNTVYLQM<br>NNLKTEDTAVYYCVRHENFGN<br>SYVSWFAHWGQGTLVTVSS | 921 |
| AC3409 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 922 | EVQLLESGGGIVQPGGSLKLSC<br>AASGFTFNTYAMNWVRQAPG<br>KGLEWVARIRSKYNNGATYYA<br>DSVKDRFTISRDDSKNTVYLQM<br>NNLKTEDTAVYYCVRHENFGN<br>SYVSWFAHWGQGTLVTVSS | 923 |
| AC3410 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 924 | EVQLLESGGGIVQPGGSLKLSC<br>AASGFTFNTYAMNWVRQAPG<br>KGLEWVARIRSKYNNFATYYA<br>DSVKDRFTISRDDSKNTVYLQM<br>NNLKTEDTAVYYCVRHENFGN<br>SYVSWFAHWGQGTLVTVSS | 925 |
| AC3411 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 926 | EVQLLESGGGIVQPGGSLKLSC<br>AASGFTFNTYAMNWVRQAPG<br>KGLEWVARIRSKYNNWATYYA<br>DSVKDRFTISRDDSKNTVYLQM<br>NNLKTEDTAVYYCVRHENFGN<br>SYVSWFAHWGQGTLVTVSS | 927 |
| AC3412 | ELVVTQEPSLTVSPGGTVTL<br>TCRSSNGAVTSSNYANWV<br>QQKPGQAPRGLIGGTNKRA<br>PGTPARFSGSLLGGKAALTL<br>SGVQPEDEAVYYCALWYPN<br>LWVFGGGTKLTVL | 928 | EVQLLESGGGIVQPGGSLKLSC<br>AASGFTFNTYAMNWVRQAPG<br>KGLEWVARIRSKYNNYGTYYA<br>DSVKDRFTISRDDSKNTVYLQM<br>NNLKTEDTAVYYCVRHENFGN<br>SYVSWFAHWGQGTLVTVSS | 929 |

TABLE 23a-continued

| | | | | |
|---|---|---|---|---|
| AC3413 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 930 | EVQLLESGGGIVQPGGSLKLSC AASGFTFNTYAMNWVRQAPG KGLEWVARIRSKYNNYTTYYA DSVKDRFTISRDDSKNTVYLQM NNLKTEDTAVYYCVRHENFGN SYVSWFAHWGQGTLVTVSS | 931 |
| AC3414 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 932 | EVQLLESGGGIVQPGGSLKLSC AASGFTFNTYAMNWVRQAPG KGLEWVARIRSKYNNYATDYA DSVKDRFTISRDDSKNTVYLQM NNLKTEDTAVYYCVRHENFGN SYVSWFAHWGQGTLVTVSS | 933 |
| AC3415 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 934 | EVQLLESGGGIVQPGGSLKLSC AASGFTFNTYAMNWVRQAPG KGLEWVARIRSKYNNYATEYA DSVKDRFTISRDDSKNTVYLQM NNLKTEDTAVYYCVRHENFGN SYVSWFAHWGQGTLVTVSS | 935 |
| AC3416 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 936 | EVQLLESGGGIVQPGGSLKLSC AASGFTFNTYAMNWVRQAPG KGLEWVARIRSKYNNYATTYA DSVKDRFTISRDDSKNTVYLQM NNLKTEDTAVYYCVRHENFGN SYVSWFAHWGQGTLVTVSS | 937 |
| AC3417 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 938 | EVQLLESGGGIVQPGGSLKLSC AASGFTFNTYAMNWVRQAPG KGLEWVARIRSKYNNYATYDA DSVKDRFTISRDDSKNTVYLQM NNLKTEDTAVYYCVRHENFGN SYVSWFAHWGQGTLVTVSS | 939 |
| AC3418 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 940 | EVQLLESGGGIVQPGGSLKLSC AASGFTFNTYAMNWVRQAPG KGLEWVARIRSKYNNYATYEA DSVKDRFTISRDDSKNTVYLQM NNLKTEDTAVYYCVRHENFGN SYVSWFAHWGQGTLVTVSS | 941 |
| AC3419 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 942 | EVQLLESGGGIVQPGGSLKLSC AASGFTFNTYAMNWVRQAPG KGLEWVARIRSKYNNYATYQA DSVKDRFTISRDDSKNTVYLQM NNLKTEDTAVYYCVRHENFGN SYVSWFAHWGQGTLVTVSS | 943 |
| AC3420 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 944 | EVQLLESGGGIVQPGGSLKLSC AASGFTFNTYAMNWVRQAPG KGLEWVARIRSKYNNYATYGA DSVKDRFTISRDDSKNTVYLQM NNLKTEDTAVYYCVRHENFGN SYVSWFAHWGQGTLVTVSS | 945 |
| AC3421 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 946 | EVQLLESGGGIVQPGGSLKLSC AASGFTFNTYAMNWVRQAPG KGLEWVARIRSKYNNYATYWA DSVKDRFTISRDDSKNTVYLQM NNLKTEDTAVYYCVRHENFGN SYVSWFAHWGQGTLVTVSS | 947 |
| AC3422 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 948 | EVQLLESGGGIVQPGGSLKLSC AASGFTFNTYAMNWVRQAPG KGLEWVARIRSKYNNYATYYK DSVKDRFTISRDDSKNTVYLQM NNLKTEDTAVYYCVRHENFGN SYVSWFAHWGQGTLVTVSS | 949 |
| AC3423 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 950 | EVQLLESGGGIVQPGGSLKLSC AASGFTFNTYAMNWVRQAPG KGLEWVARIRSKYNNYATYYP DSVKDRFTISRDDSKNTVYLQM NNLKTEDTAVYYCVRHENFGN SYVSWFAHWGQGTLVTVSS | 951 |
| AC3424 | ELVVTQEPSLTVSPGGTVTL TCRSSNGAVTSSNYANWV QQKPGQAPRGLIGGTNKRA | 952 | EVQLLESGGGIVQPGGSLKLSC AASGFTFNTYAMNWVRQAPG KGLEWVARIRSKYNNYATYYA | 953 |

TABLE 23a-continued

| | | | | |
|---|---|---|---|---|
| | PGTPARFSGSLLGGKAALTL SGVQPEDEAVYYCALWYPN LWVFGGGTKLTVL | | DSVKGRFTISRDDSKNTVYLQ MNNLKTEDTAVYYCVRHENFG NSYVSWFAHWGQGTLVTVSS | |
| AC3425 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 954 | EVQLLESGGGIVQPGGSLKLSC AASGFTFNTYAMNWVRQAPG KGLEWVARIRSKYNNYATYYA DSVKDRFTISRDDSKNTVDLQ MNNLKTEDTAVYYCVRHENFG NSYVSWFAHWGQGTLVTVSS | 955 |
| AC3426 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 956 | EVQLLESGGGIVQPGGSLKLSC AASGFTFNTYAMNWVRQAPG KGLEWVARIRSKYNNYATYYA DSVKDRFTISRDDSKNTVGLQ MNNLKTEDTAVYYCVRHENFG NSYVSWFAHWGQGTLVTVSS | 957 |
| AC3427 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 958 | EVQLLESGGGIVQPGGSLKLSC AASGFTFNTYAMNWVRQAPG KGLEWVARIRSKYNNYATYYA DSVKDRFTISRDDSKNTVSLQM NNLKTEDTAVYYCVRHENFGN SYVSWFAHWGQGTLVTVSS | 959 |
| AC3428 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 960 | EVQLLESGGGIVQPGGSLKLSC AASGFTFNTYAMNWVRQAPG KGLEWVARIRSKYNNYATYYA DSVKDRFTISRDDSKNTVYLQM NELKTEDTAVYYCVRHENFGN SYVSWFAHWGQGTLVTVSS | 961 |
| AC3429 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 962 | EVQLLESGGGIVQPGGSLKLSC AASGFTFNTYAMNWVRQAPG KGLEWVARIRSKYNNYATYYA DSVKDRFTISRDDSKNTVYLQM NQLKTEDTAVYYCVRHENFGN SYVSWFAHWGQGTLVTVSS | 963 |
| AC3430 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 964 | EVQLLESGGGIVQPGGSLKLSC AASGFTFNTYAMNWVRQAPG KGLEWVARIRSKYNNYATYYA DSVKDRFTISRDDSKNTVYLQM NSLKTEDTAVYYCVRHENFGN SYVSWFAHWGQGTLVTVSS | 965 |
| AC3431 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 966 | EVQLLESGGGIVQPGGSLKLSC AASGFTFNTYAMNWVRQAPG KGLEWVARIRSKYNNYATYYA DSVKDRFTISRDDSKNTVYLQM NYLKTEDTAVYYCVRHENFGN SYVSWFAHWGQGTLVTVSS | 967 |
| AC3432 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 968 | EVQLLESGGGIVQPGGSLKLSC AASGFTFNTYAMNWVRQAPG KGLEWVGRIRSKYNNGATYYA DSVKGRFTISRDDSKNTVYLQ MNSLKTEDTAVYYCVRHENFG NSYVSWFAHWGQGTLVTVSS | 969 |
| AC3433 | ELVVTQEPSLTVSPGGTVTL TCRSSNGAVTSSNYANWV QQKPGQAPRGLIGGTNKRA PGTPARFSGSLQGGKAALT LSGVQPEDEAVYYCALWYP NLWVFGGGTKLTVL | 970 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 971 |
| AC3434 | ELVVTQEPSLTVSPGGTVTL TCRSSNGAVTSSNYANWV QQKPGQAPRGLIGGTNKRA PGTPARFSGSLLEGKAALTL SGVQPEDEAVYYCALWYPN LWVFGGGTKLTVL | 972 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 973 |
| AC3435 | ELVVTQEPSLTVSPGGTVTL TCRSSNGAVTSSNYANWV QQKPGQAPRGLIGGTNKRA PGTPARFSGSLDGGKAALT LSGVQPEDEAVYYCALWYP NLWVFGGGTKLTVL | 974 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 975 |

TABLE 23a-continued

| AC | | | | | | |
|---|---|---|---|---|---|---|
| AC3436 | ELVVTQEPSLTVSPGGTVTL TCRSSNGAVTSSNYANWV QQKPGQAPRGLIGGTNKRA PGTPARFSGSSLGGKAALT LSGVQPEDEAVYYCALWYP NLWVFGGGTKLTVL | 976 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 977 | | |
| AC3437 | ELVVTQEPSLTVSPGGTVTL TCRSSNGAVTSSNYANWV QQKPGQAPRGLIGGTNKRA PGTPARFSGSKLGGKAALT LSGVQPEDEAVYYCALWYP NLWVFGGGTKLTVL | 978 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 979 | | |
| AC3438 | ELVVTQEPSLTVSPGGTVTL TCRSSNGAVTSSNYANWV QQKPGQAPRGLIGGTNKRA PGTPARFSGSNLGGKAALT LSGVQPEDEAVYYCALWYP NLWVFGGGTKLTVL | 980 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 981 | | |
| AC3439 | ELVVTQEPSLTVSPGGTVTL TCRSSNGAVTSSNYANWV QQKPGQAPRGLIGGTNKRA PGTPARFSGSTLGGKAALT LSGVQPEDEAVYYCALWYP NLWVFGGGTKLTVL | 982 | EVQLLESGGGIVQPGGSLKLSC AASGFTFNTYAMNWVRQAPG KGLEWVARIRSKYNNYATYYA DSVKDRFTISRDDSKNTVYLQM NNLKTEDTAVYYCVRHENFGN SYVSWFAHWGQGTLVTVSS | 983 | | |

| AC | CD3.23 domain | Mutation | PTE score v12 | Relative Expression (1-lowest expression, 5-highest expression-evaluates by PEG gel electrophoresis) | Primary $K_D$ (nM) | % Remaining after heating |
|---|---|---|---|---|---|---|
| AC3364 | CD3.23-L7 | WT | 50 | 4 | 8.5 | 56.90% |
| AC3366 | CD3.23-D | WT | 50 | 3 | 14.0 | 28.73% |
| AC3367 | CD3.38 | W47D | 41 | 4 | 40.2 | ND |
| AC3368 | CD3.39 | W47E | 42 | 4 | 18.1 | 0 |
| AC3369 | CD3.40 | V48A | 38 | 4 | 8.3 | 0 |
| AC3370 | CD3.41 | V48E | 38 | 4 | 164.8 | ND |
| AC3371 | CD3.42 | V48G | 38 | 4 | 71.5 | ND |
| AC3372 | CD3.43 | V48S | 38 | 4 | 11.2 | 0 |
| AC3373 | CD3.44 | V48T | 38 | 4 | 5.7 | 0 |
| AC3374 | CD3.45 | V48W | 40 | 4 | 34270.0 | ND |
| AC3375 | CD3.46 | A49D | 48 | 4 | Weak binding | ND |
| AC3376 | CD3.47 | A49E | 46 | 4 | No binding | ND |
| AC3377 | CD3.48 | A49G | 45 | 4 | 4.5 | ND |
| AC3378 | CD3.49 | R50Q | 39 | 4 | No binding | ND |
| AC3379 | CD3.50 | R50G | 39 | 4 | No binding | ND |
| AC3380 | CD3.51 | R50H | 41 | 4 | No binding | ND |
| AC3381 | CD3.52 | R509 | 39 | 4 | No binding | ND |
| AC3382 | CD3.53 | R50W | 39 | 2 | No binding | ND |
| AC3383 | CD3.54 | I51A | 45 | 2 | 1182.0 | ND |
| AC3384 | CD3.55 | I51G | 42 | 2 | Weak binding | ND |
| AC3385 | CD3.56 | I51T | 44 | 2 | 424.6 | ND |
| AC3386 | CD3.57 | R52N | 39 | 2 | No binding | ND |
| AC3387 | CD3.58 | R52D | 35 | 2 | No binding | ND |

TABLE 23a-continued

| | | | | | | |
|---|---|---|---|---|---|---|
| AC3388 | CD3.59 | R52E | 35 | 2 | No binding | ND |
| AC3389 | CD3.60 | E52Q | 48 | 2 | 434.4 | ND |
| AC3390 | CD3.61 | R52G | 41 | 2 | No binding | ND |
| AC3391 | CD3.62 | R52H | 50 | 2 | No binding | ND |
| AC3392 | CD3.63 | R52W | 42 | 2 | No binding | ND |
| AC3393 | CD3.64 | S52aN | 48 | 2 | Weak binding | ND |
| AC3394 | CD3.65 | S52aD | 42 | 4 | No binding | ND |
| AC3395 | CD3.66 | S52aE | 42 | 4 | No binding | ND |
| AC3396 | CD3.67 | S52aT | 49 | 4 | 4.8 | 60.06% |
| AC3397 | CD3.68 | K52bP | 45 | 4 | 51.0 | ND |
| AC3398 | CD3.69 | Y52cA | 37 | 4 | 11.5 | 14.99% |
| AC3399 | CD3.70 | Y52cR | 38 | 4 | 3.8 | 56.68% |
| AC3400 | CD3.71 | Y52cG | 36 | 4 | 20.1 | 0 |
| AC3401 | CD3.72 | Y52cK | 40 | 4 | 5.1 | 60.72% |
| AC3402 | CD3.73 | Y52cP | 36 | 4 | 33.1 | ND |
| AC3403 | CD3.74 | Y52cT | 36 | 4 | 11.1 | 35.59% |
| AC3404 | CD3.75 | Y52cW | 48 | 4 | 10.5 | 15.25% |
| AC3405 | CD3.76 | N53D | 34 | 4 | No binding | ND |
| AC3406 | CD3.77 | N53E | 34 | 4 | 574.6 | ND |
| AC3407 | CD3.78 | N54D | 37 | 4 | 7.4 | 61.45% |
| AC3408 | CD3.79 | N54E | 42 | 4 | 8.3 | 43.27% |
| AC3409 | CD3.80 | Y55G | 34 | 4 | 11.3 | 0 |
| AC3410 | CD3.81 | Y55F | 44 | 4 | 6.1 | 23.50% |
| AC3411 | CD3.82 | Y55W | 38 | 4 | 7.8 | 6.79% |
| AC3412 | CD3.83 | A56G | 49 | 4 | 8.2 | 9.14% |
| AC3413 | CD3.84 | A56T | 49 | 4 | 10.7 | 26.45% |
| AC3414 | CD3.85 | Y58D | 35 | 4 | 938.6 | ND |
| AC3415 | CD3.86 | Y58E | 35 | 4 | 183.4 | ND |
| AC3416 | CD3.87 | Y58T | 35 | 4 | 17.9 | 26.86% |
| AC3417 | CD3.88 | Y59D | 42 | 4 | 63.2 | ND |
| AC3418 | CD3.89 | Y59E | 42 | 4 | 9.7 | 0 |
| AC3419 | CD3.90 | Y59Q | 42 | 4 | 7.2 | 0 |
| AC3420 | CD3.91 | Y59G | 42 | 4 | 8.3 | 0 |
| AC3421 | CD3.92 | Y59W | 42 | 4 | 37.2 | ND |
| AC3422 | CD3.93 | A60K | 37 | 4 | 8.0 | 0 |
| AC3423 | CD3.94 | A60P | 35 | 4 | 8.2 | 0 |
| AC3424 | CD3.95 | D65G | 46 | 4 | 5.4 | 47.80% |
| AC3425 | CD3.96 | Y79D | 3 | 4 | 9.8 | 0 |
| AC3426 | CD3.97 | Y79G | 31 | 2 | 121.1 | ND |
| AC3427 | CD3.98 | Y79S | 31 | 4 | 9.6 | 0 |

TABLE 23a-continued

| AC3428 | CD3.99 | N82bE | 39 | 4 | 5.9 | 39.70% |
| AC3429 | CD3.100 | N82bQ | 40 | 4 | 7.1 | 18.12% |
| AC3430 | CD3.101 | N82bS | 32 | 4 | 4.8 | 4.22% |
| AC3431 | CD3.102 | N82bY | 46 | 4 | 5.5 | 1.66% |
| AC3432 | CD3.103 | A49G, Y52cG, D65G, N82bS | 8 | 4 | 11.4 | 0 |
| AC3433 | CD3.104 | L67Q | 55 | 4 | 4.6 | 59.68% |
| AC3434 | CD3.105 | G68E | 54 | 4 | 4.9 | 70.99% |
| AC3435 | CD3.106 | L67D | 50 | 4 | 6.1 | 43.75% |
| AC3436 | CD3.107 | L66S | 50 | 4 | 7.3 | 0 |
| AC3437 | CD3.108 | L66K | 50 | 4 | 3.2 | 0 |
| AC3438 | CD3.109 | L66N | 50 | 4 | 8.3 | 0 |
| AC3439 | CD3.110 | L66T | 50 | 4 | 8.9 | 0 |

TABLE 23b

Pool 2 CD3.23 Mutation Combination Variants

| AC | VL sequence | VL SEQ ID NO: | VH sequence | VH SEQ ID NO: |
| --- | --- | --- | --- | --- |
| AC3632 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 700 | EVQLLESGGGIVQPGGSLRL SCAASGFTFNTYAMNWVRQ APGKGLEWVGRIRSKRNNYA TYYADSVKGRFTISRDDSKNT VYLQMNSLKTEDTAVYYCVR HENFGNSYVSWFAHWGQGT LVTVSS | 701 |
| AC3633 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 702 | EVQLVESGGGIVQPGGSLRL SCAASGFTFNTYAMNWVRQ APGKGLEWVGRIRSKRNNYA TYYADSVKGRFTISRDDSKNT VYLQMNSLKTEDTAVYYCVR HENFGNSYVSWFAHWGQGT LVTVSS | 703 |
| AC3634 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 704 | EVQLLESGGGIVQPGGSLRL SCAASGFTFNTYAMNWVRQ APGKGLEWVGRIRSKTNNYA TYYADSVKGRFTISRDDSKNT VYLQMNSLKTEDTAVYYCVR HENFGNSYVSWFAHWGQGT LVTVSS | 705 |
| AC3635 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 706 | EVQLVESGGGIVQPGGSLRL SCAASGFTFNTYAMNWVRQ APGKGLEWVGRIRSKTNNYA TYYADSVKGRFTISRDDSKNT VYLQMNSLKTEDTAVYYCVR HENFGNSYVSWFAHWGQGT LVTVSS | 707 |
| AC3636 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 708 | EVQLLESGGGIVQPGGSLRL SCAASGFTFNTYAMNWVRQ APGKGLEWVGRIRSKYNDYA TYYADSVKGRFTISRDDSKNT VYLQMNSLKTEDTAVYYCVR HENFGNSYVSWFAHWGQGT LVTVSS | 709 |

TABLE 23b-continued

| | | | |
|---|---|---|---|
| AC3637 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 710 | EVQLVESGGGIVQPGGSLRL SCAASGFTFNTYAMNWVRQ APGKGLEWVGRIRSKYNDYA TYYADSVKGRFTISRDDSKNT VYLQMNSLKTEDTAVYYCVR HENFGNSYVSWFAHWGQGT LVTVSS | 711 |
| AC3638 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 712 | EVQLLESGGGIVQPGGSLRL SCAASGFTFNTYAMNWVRQ APGKGLEWVGRIRSKYNNYA TTYADSVKGRFTISRDDSKNT VYLQMNSLKTEDTAVYYCVR HENFGNSYVSWFAHWGQGT LVTVSS | 713 |
| AC3639 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 714 | EVQLVESGGGIVQPGGSLRL SCAASGFTFNTYAMNWVRQ APGKGLEWVGRIRSKYNNYA TTYADSVKGRFTISRDDSKNT VYLQMNSLKTEDTAVYYCVR HENFGNSYVSWFAHWGQGT LVTVSS | 715 |
| AC3640 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 716 | EVQLVESGGGIVQPGGSLRL SCAASGFTFNTYAMNWVRQ APGKGLEWVGRIRSKRNNYA TYYADSVKGRFTISRDDSKNT VYLQMNELKTEDTAVYYCVR HENFGNSYVSWFAHWGQGT LVTVSS | 717 |
| AC3641 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 718 | EVQLVESGGGIVQPGGSLRL SCAASGFTFSTYAMNWVRQA PGKGLEWVGRIRSKRNNYAT YYADSVKGRFTISRDDSKNTV YLQMNELKTEDTAVYYCVRH ENFGNSYVSWFAHWGQGTL VTVSS | 719 |
| AC3642 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 720 | EVQLVESGGGIVQPGGSLRL SCAASGFTFNTYAMNWVRQ APGKGLEWVGRIRSKTNNYA TYYADSVKGRFTISRDDSKNT VYLQMNELKTEDTAVYYCVR HENFGNSYVSWFAHWGQGT LVTVSS | 72 |
| AC3643 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 722 | EVQLVESGGGIVQPGGSLRL SCAASGFTFSTYAMNWVRQA PGKGLEWVGRIRSKTNNYAT YYADSVKGRFTISRDDSKNTV YLQMNELKTEDTAVYYCVRH ENFGNSYVSWFAHWGQGTL VTVSS | 723 |
| AC3644 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 724 | EVQLVESGGGIVQPGGSLRL SCAASGFTFNTYAMNWVRQ APGKGLEWVGRIRSKYNDYA TYYADSVKGRFTISRDDSKNT VYLQMNELKTEDTAVYYCVR HENFGNSYVSWFAHWGQGT LVTVSS | 725 |
| AC3645 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 726 | EVQLVESGGGIVQPGGSLRL SCAASGFTFSTYAMNWVRQA PGKGLEWVGRIRSKYNDYAT YYADSVKGRFTISRDDSKNTV YLQMNELKTEDTAVYYCVRH ENFGNSYVSWFAHWGQGTL VTVSS | 727 |
| AC3646 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 728 | EVQLVESGGGIVQPGGSLRL SCAASGFTFSTYAMNWVRQA PGKGLEWVGRIRSKRNNYAT YYADSVKGRFTISRDDSKNTV YLQMNSLKTEDTAVYYCVRH ENFGNSYVSWFAHWGQGTL VTVSS | 729 |

TABLE 23b-continued

| | | | |
|---|---|---|---|
| AC3647 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 730 | EVQLVESGGGIVQPGGSLRL SCAASGFTFSTYAMNWVRQA PGKGLEWVGRIRSKTNNYAT YYADSVKGRFTISRDDSKNTV YLQMNSLKTEDTAVYYCVRH ENFGNSYVSWFAHWGQGTL VTVSS | 731 |
| AC3648 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 732 | EVQLVESGGGIVQPGGSLRL SCAASGFTFSTYAMNWVRQA PGKGLEWVGRIRSKYNDYAT YYADSVKGRFTISRDDSKNTV YLQMNSLKTEDTAVYYCVRH ENFGNSYVSWFAHWGQGTL VTVSS | 733 |
| AC3649 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 734 | EVQLVESGGGIVQPGGSLRL SCAASGFTFSTYAMNWVRQA PGKGLEWVGRIRSKYNNYAT YYADSVKGRFTISRDDSKNTV YLQMNSLKTEDTAVYYCVRH ENFGNSYVSWFAHWGQGTL VTVSS | 735 |
| AC3650 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 736 | EVQLVESGGGIVQPGGSLRL SCAASGFTFNTYAMNWVRQ APGKGLEWVGRIRTKRNNYA TYYADSVKGRFTISRDDSKNT VYLQMNELKTEDTAVYYCVR HENFGNSYVSWFAHWGQGT LVTVSS | 737 |
| AC3651 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 738 | EVQLVESGGGIVQPGGSLRL SCAASGFTFSTYAMNWVRQA PGKGLEWVGRIRTKRNNYAT YYADSVKGRFTISRDDSKNTV YLQMNELKTEDTAVYYCVRH ENFGNSYVSWFAHWGQGTL VTVSS | 739 |
| AC3652 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 740 | EVQLVESGGGIVQPGGSLRL SCAASGFTFNTYAMNWVRQ APGKGLEWVGRIRTKTNNYA TYYADSVKGRFTISRDDSKNT VYLQMNELKTEDTAVYYCVR HENFGNSYVSWFAHWGQGT LVTVSS | 741 |
| AC3653 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 742 | EVQLVESGGGIVQPGGSLRL SCAASGFTFSTYAMNWVRQA PGKGLEWVGRIRTKTNNYAT YYADSVKGRFTISRDDSKNTV YLQMNELKTEDTAVYYCVRH ENFGNSYVSWFAHWGQGTL VTVSS | 743 |
| AC3654 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 744 | EVQLVESGGGIVQPGGSLRL SCAASGFTFNTYAMNWVRQ APGKGLEWVGRIRTKYNDYA TYYADSVKGRFTISRDDSKNT VYLQMNELKTEDTAVYYCVR HENFGNSYVSWFAHWGQGT LVTVSS | 745 |
| AC3655 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 746 | EVQLVESGGGIVQPGGSLRL SCAASGFTFSTYAMNWVRQA PGKGLEWVGRIRTKYNDYAT YYADSVKGRFTISRDDSKNTV YLQMNELKTEDTAVYYCVRH ENFGNSYVSWFAHWGQGTL VTVSS | 747 |
| AC3656 | ELVVTQEPSLTVSPGGTVTL TCRSSNGAVTSSNYANWV QQKPGQAPRGLIGGTNKRA PGTPARFSGSLLGKAALTL SGVQPEDEAVYYCALWYPN LWVFGGGTKLTVL | 748 | EVQLVESGGGIVQPGGSLRL SCAASGFTFNTYAMNWVRQ APGKGLEWVGRIRTKYNNYA TTYADSVKGRFTISRDDSKNT VYLQMNELKTEDTAVYYCVR HENFGNSYVSWFAHWGQGT LVTVSS | 749 |

TABLE 23b-continued

| | | | | |
|---|---|---|---|---|
| AC3657 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 750 | EVQLVESGGGIVQPGGSLRL SCAASGFTFSTYAMNWVRQA PGKGLEWVGRIRTKYNNYAT TYADSVKGRFTISRDDSKNTV YLQMNELKTEDTAVYYCVRH ENFGNSYVSWFAHWGQGTL VTVSS | 751 |
| AC3658 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 752 | EVQLVESGGGIVQPGGSLRL SCAASGFTFNTYAMNWVRQ APGKGLEWVGRIRTKRNNYA TYYADSVKGRFTISRDDSKNT VYLQMNSLKTEDTAVYYCVR HENFGNSYVSWFAHWGQGT LVTVSS | 753 |
| AC3659 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 754 | EVQLVESGGGIVQPGGSLRL SCAASGFTFSTYAMNWVRQA PGKGLEWVGRIRTKRNNYAT YYADSVKGRFTISRDDSKNTV YLQMNSLKTEDTAVYYCVRH ENFGNSYVSWFAHWGQGTL VTVSS | 755 |
| AC3660 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 756 | EVQLVESGGGIVQPGGSLRL SCAASGFTFNTYAMNWVRQ APGKGLEWVGRIRTKTNNYA TYYADSVKGRFTISRDDSKNT VYLQMNSLKTEDTAVYYCVR HENFGNSYVSWFAHWGQGT LVTVSS | 757 |
| AC3661 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 758 | EVQLVESGGGIVQPGGSLRL SCAASGFTFSTYAMNWVRQA PGKGLEWVGRIRTKTNNYAT YYADSVKGRFTISRDDSKNTV YLQMNSLKTEDTAVYYCVRH ENFGNSYVSWFAHWGQGTL VTVSS | 759 |
| AC3662 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 760 | EVQLVESGGGIVQPGGSLRL SCAASGFTFNTYAMNWVRQ APGKGLEWVGRIRTKYNDYA TYYADSVKGRFTISRDDSKNT VYLQMNSLKTEDTAVYYCVR HENFGNSYVSWFAHWGQGT LVTVSS | 761 |
| AC3663 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 762 | EVQLVESGGGIVQPGGSLRL SCAASGFTFSTYAMNWVRQA PGKGLEWVGRIRTKYNDYAT YYADSVKGRFTISRDDSKNTV YLQMNSLKTEDTAVYYCVRH ENFGNSYVSWFAHWGQGTL VTVSS | 763 |
| AC3664 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 764 | EVQLVESGGGIVQPGGSLRL SCAASGFTFNTYAMNWVRQ APGKGLEWVGRIRTKYNNYA TTYADSVKGRFTISRDDSKNT VYLQMNSLKTEDTAVYYCVR HENFGNSYVSWFAHWGQGT LVTVSS | 765 |
| AC3665 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 766 | EVQLVESGGGIVQPGGSLRL SCAASGFTFSTYAMNWVRQA PGKGLEWVGRIRTKYNNYAT TYADSVKGRFTISRDDSKNTV YLQMNSLKTEDTAVYYCVRH ENFGNSYVSWFAHWGQGTL VTVSS | 767 |
| AC3666 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 768 | EVQLVESGGGIVQPGGSLRL SCAASGFTFNTYAMNWVRQ APGKGLEWVGRIRSKYNEYA TYYADSVKGRFTISRDDSKNT VYLQMNSLKTEDTAVYYCVR HENFGNSYVSWFAHWGQGT LVTVSS | 769 |

TABLE 23b-continued

| | | | | |
|---|---|---|---|---|
| AC3667 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 770 | EVQLVESGGGIVQPGGSRLSCAASGFTFNTYAMNWVRQAPGKGLEWVGRIRSKYNNGATYYADSVKGRFTISRDDSKNTVYLQMNSLKTEDTAVYYCVRHENFGNSYVSWFAHWGQGTLVTVSS | 771 |
| AC3668 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 772 | EVQLVESGGGIVQPGGSRLSCAASGFTFNTYAMNWVRQAPGKGLEWVGRIRSKYNNGATYYADSVKGRFTISRDDSKNTVYLQMNELKTEDTAVYYCVRHENFGNSYVSWFAHWGQGTLVTVSS | 773 |
| AC3669 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 774 | EVQLVESGGGIVQPGGSRLSCAASGFTFNTYAMNWVRQAPGKGLEWVARIRTKYNNYATTYADSVKDRFTISRDDSKNTVYLQMNSLKTEDTAVYYCVRHENFGNSYVSWFAHWGQGTLVTVSS | 775 |
| AC3670 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 776 | EVQLVESGGGIVQPGGSRLSCAASGFTFNTYAMNWVRQAPGKGLEWVARIRSKRNNYATTYADSVKDRFTISRDDSKNTVYLQMNSLKTEDTAVYYCVRHENFGNSYVSWFAHWGQGTLVTVSS | 777 |
| AC3671 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 778 | EVQLVESGGGIVQPGGSRLSCAASGFTFNTYAMNWVRQAPGKGLEWVARIRSKKNNYATTYADSVKDRFTISRDDSKNTVYLQMNSLKTEDTAVYYCVRHENFGNSYVSWFAHWGQGTLVTVSS | 779 |
| AC3672 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 780 | EVQLVESGGGIVQPGGSRLSCAASGFTFNTYAMNWVRQAPGKGLEWVARIRSKTNNYATTYADSVKDRFTISRDDSKNTVYLQMNSLKTEDTAVYYCVRHENFGNSYVSWFAHWGQGTLVTVSS | 781 |
| AC3673 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 782 | EVQLVESGGGIVQPGGSRLSCAASGFTFNTYAMNWVRQAPGKGLEWVGRIRSKYNDYATYYADSVKGRFTISRDDSKNTLYLQMNSLKTEDTAVYYCVRHENFGNSYVSWFAHWGQGTLVTVSS | 783 |
| AC3674 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 784 | EVQLVESGGGIVQPGGSRLSCAASGFTFNTYAMNWVRQAPGKGLEWVGRIRSKYNEYATYYADSVKGRFTISRDDSKNTLYLQMNSLKTEDTAVYYCVRHENFGNSYVSWFAHWGQGTLVTVSS | 785 |
| AC3675 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 786 | EVQLVESGGGIVQPGGSRLSCAASGFTFNTYAMNWVRQAPGKGLEWVGRIRSKYNNGATYYADSVKGRFTISRDDSKNTLYLQMNSLKTEDTAVYYCVRHENFGNSYVSWFAHWGQGTLVTVSS | 787 |
| AC3676 | ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL | 788 | EVQLVESGGGIVQPGGSRLSCAASGFTFNTYAMNWVRQAPGKGLEWVGRIRSKYNNGATYYADSVKGRFTISRDDSKNTLYLQMNELKTEDTAVYYCVRHENFGNSYVSWFAHWGQGTLVTVSS | 789 |

TABLE 23b-continued

| | | | | |
|---|---|---|---|---|
| AC3677 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 790 | EVQLVESGGGIVQPGGSLRL SCAASGFTFNTYAMNWVRQ APGKGLEWVARIRTKYNNYA TTYADSVKDRFTISRDDSKNT LYLQMNSLKTEDTAVYYCVR HENFGNSYVSWFAHWGQGT LVTVSS | 791 |
| AC3678 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 792 | EVQLVESGGGIVQPGGSLRL SCAASGFTFNTYAMNWVRQ APGKGLEWVARIRSKRNNYA TTYADSVKDRFTISRDDSKNT LYLQMNSLKTEDTAVYYCVR HENFGNSYVSWFAHWGQGT LVTVSS | 793 |
| AC3679 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 794 | EVQLVESGGGIVQPGGSLRL SCAASGFTFNTYAMNWVRQ APGKGLEWVARIRSKKNNYA TTYADSVKDRFTISRDDSKNT LYLQMNSLKTEDTAVYYCVR HENFGNSYVSWFAHWGQGT LVTVSS | 795 |
| AC3680 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 796 | EVQLVESGGGIVQPGGSLRL SCAASGFTFNTYAMNWVRQ APGKGLEWVARIRSKTNNYA TTYADSVKDRFTISRDDSKNT LYLQMNSLKTEDTAVYYCVR HENFGNSYVSWFAHWGQGT LVTVSS | 797 |
| AC3681 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 798 | EVQLVESGGGIVQPGGSLRL SCAASGFTFNTYAMNWVRQ APGKGLEWVGRIRTKYNNYA TTYADSVKDRFTISRDDSKNT VYLQMNSLKTEDTAVYYCVR HENFGNSYVSWFAHWGQGT LVTVSS | 799 |
| AC3682 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 800 | EVQLVESGGGIVQPGGSLRL SCAASGFTFNTYAMNWVRQ APGKGLEWVGRIRSKRNNYA TTYADSVKDRFTISRDDSKNT VYLQMNSLKTEDTAVYYCVR HENFGNSYVSWFAHWGQGT LVTVSS | 801 |
| AC3683 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 802 | EVQLVESGGGIVQPGGSLRL SCAASGFTFNTYAMNWVRQ APGKGLEWVGRIRSKKNNYA TTYADSVKDRFTISRDDSKNT VYLQMNSLKTEDTAVYYCVR HENFGNSYVSWFAHWGQGT LVTVSS | 803 |
| AC3684 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 804 | EVQLVESGGGIVQPGGSLRL SCAASGFTFNTYAMNWVRQ APGKGLEWVGRIRSKTNNYA TTYADSVKDRFTISRDDSKNT VYLQMNSLKTEDTAVYYCVR HENFGNSYVSWFAHWGQGT LVTVSS | 805 |
| AC3685 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 806 | EVQLVESGGGIVQPGGSLRL SCAASGFTFNTYAMNWVRQ APGKGLEWVGRIRTKYNNYA TTYADSVKDRFTISRDDSKNT VYLQMNELKTEDTAVYYCVR HENFGNSYVSWFAHWGQGT LVTVSS | 807 |
| AC3686 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 808 | EVQLVESGGGIVQPGGSLRL SCAASGFTFNTYAMNWVRQ APGKGLEWVGRIRSKRNNYA TTYADSVKDRFTISRDDSKNT VYLQMNELKTEDTAVYYCVR HENFGNSYVSWFAHWGQGT LVTVSS | 809 |

TABLE 23b-continued

| | | | |
|---|---|---|---|
| AC3687 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 810 | EVQLVESGGGIVQPGGSLRL SCAASGFTFNTYAMNWVRQ APGKGLEWVGRIRSKKNNYA TTYADSVKDRFTISRDDSKNT VYLQMNELKTEDTAVYYCVR HENFGNSYVSWFAHWGQGT LVTVSS | 811 |
| AC3688 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 812 | EVQLVESGGGIVQPGGSLRL SCAASGFTFNTYAMNWVRQ APGKGLEWVGRIRSKTNNYA TTYADSVKDRFTISRDDSKNT VYLQMNELKTEDTAVYYCVR HENFGNSYVSWFAHWGQGT LVTVSS | 813 |
| AC3689 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 814 | EVQLVESGGGIVQPGGSLRL SCAASGFTFNTYAMNWVRQ APGKGLEWVGRIRTKYNNYA TTYADSVKDRFTISRDDSKNT LYLQMNSLKTEDTAVYYCVR HENFGNSYVSWFAHWGQGT LVTVSS | 815 |
| AC3690 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 816 | EVQLVESGGGIVQPGGSLRL SCAASGFTFNTYAMNWVRQ APGKGLEWVGRIRSKRNNYA TTYADSVKDRFTISRDDSKNT LYLQMNSLKTEDTAVYYCVR HENFGNSYVSWFAHWGQGT LVTVSS | 817 |
| AC3691 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 818 | EVQLVESGGGIVQPGGSLRL SCAASGFTFNTYAMNWVRQ APGKGLEWVGRIRSKKNNYA TTYADSVKDRFTISRDDSKNT LYLQMNSLKTEDTAVYYCVR HENFGNSYVSWFAHWGQGT LVTVSS | 819 |
| AC3692 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 820 | EVQLVESGGGIVQPGGSLRL SCAASGFTFNTYAMNWVRQ APGKGLEWVGRIRSKTNNYA TTYADSVKDRFTISRDDSKNT LYLQMNSLKTEDTAVYYCVR HENFGNSYVSWFAHWGQGT LVTVSS | 821 |
| AC3693 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 822 | EVQLVESGGGIVQPGGSLRL SCAASGFTFNTYAMNWVRQ APGKGLEWVGRIRSKRNNYA TTYADSVKDRFTISRDDSKNT LYLQMNELKTEDTAVYYCVR HENFGNSYVSWFAHWGQGT LVTVSS | 823 |
| AC3694 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 824 | EVQLVESGGGIVQPGGSLKL SCAASGFTFNTYAMNWVRQ APGKGLEWVGRIRTKRNNYA TYYADSVKGRFTISRDDSKNT VYLQMNSLKTEDTAVYYCVR HENFGNSYVSWFAHWGQGT LVTVSS | 825 |
| AC3695 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 826 | EVQLVESGGGIVQPGGSLKL SCAASGFTFSTYAMNWVRQA PGKGLEWVGRIRTKRNNYAT YYADSVKGRFTISRDDSKNTV YLQMNSLKTEDTAVYYCVRH ENFGNSYVSWFAHWGQGTL VTVSS | 827 |
| AC3471 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | 828 | EVQLLESGGGIVQPGGSLKL SCAASGFTFNTYAMNWVRQ APGKGLEWVARIRSKYNNYA TYYADSVKDRFTISRDDSKNT VYLQMNNLKTEDTAVYYCVR HENFGNSYVSWFAHWGQGT LVTVSS | 829 |

TABLE 23b-continued

| AC | | | | | | | | |
|---|---|---|---|---|---|---|---|---|
| AC3432 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | | 830 | EVQLLESGGGIVQPGGSLKL SCAASGFTFNTYAMNWVRQ APGKGLEWVGRIRSKYNNGA TYYADSVKGRFTISRDDSKNT VYLQMNSLKTEDTAVYYCVR HENFGNSYVSWFAHWGQGT LVTVSS | | 831 | | |
| AC2717 | ELVVTQEPSLTVSPGGTVTL TCRSSNGAVTSSNYANWV QQKPGQAPRGLIGGTNKRA PGTPARFSGSLLGGKAALTL SGVQPEDEAVYYCALWYPN LWVFGGGTKLTVL | | 832 | EVQLLESGGGIVQPGGSLKL SCAASGFTFNTYAMNWVRQ APGKGLEWVARIRSKYNNYA TYYADSVKDRFTISRDDSKNT VYLQMNNLKTEDTAVYYCVR HENFGNSYVSWFAHWGQGT LVTVSS | | 833 | | |

| AC | CD3.23 domain | Mutation | PTE score v12 | PTE score v22 | Expression Level** | Expression Ratio** | Primary Screen huCD3e (nM) | % Remaining of stability |
|---|---|---|---|---|---|---|---|---|
| AC3632 | CD3.201 | K19R, A49G, Y52cR, D65G, N82bS | 9 | 18 | 3050.0 | 1.2 | 8.6 | 55.24% |
| AC3633 | CD3.202 | L5V, K19R, A49G, Y52cR, D65G, N82bS | 9 | 18 | 2220.0 | 0.9 | 8.4 | 60.79% |
| AC3634 | CD3.203 | K19R, A49G, Y52cT, D65G, N82bS | 10 | 19 | ND | ND | ND | ND |
| AC3635 | CD3.204 | L5V, K19R, A49G, Y52cT, D65G, N82bS | 10 | 19 | 1870.0 | 0.8 | 7.2 | 36.92% |
| AC3636 | CD3.205 | K19R, A49G, N54D, D65G, N82bS | 10 | 19 | 3000.0 | 1.2 | 7.2 | 58.50% |
| AC3637 | CD3.206 | L5V, K19R, A49G, N54D, D65G, N82bS | 10 | 19 | 1450.0 | 0.6 | 10.3 | 28.98% |
| AC3638 | CD3.207 | K19R, A49G, Y58T, D65G, N82bS | 12 | 21 | 2420.0 | 1.0 | 15.6 | 1.01% |
| A3639 | CD3.208 | L5V, K19R, A49G, Y58T, D65G, N82bS | 12 | 21 | 2400.0 | 1.0 | 16.8 | 24.61% |
| AC3640 | CD3.209 | L5V, K19R, A49G, Y52cR, D65G, N82bE | 16 | 25 | 2280.0 | 0.9 | 5.6 | 37.31% |

TABLE 23b-continued

| | | | | | | | | |
|---|---|---|---|---|---|---|---|---|
| AC3641 | CD3.210 | L5V, K19R, N30S, A49G, Y52cR, D65G, N82bE | 16 | 25 | 2120.0 | 0.9 | 5.7 | 69.25% |
| AC3642 | CD3.211 | L5V, K19R, A49G, Y52cT, D65G, N82bE | 17 | 26 | 2610.0 | 1.1 | 9.5 | 29.37% |
| AC3643 | CD3.212 | L5V, K19R, N30S, A49G, Y52cT, D65G, N82bE | 17 | 26 | 890.0 | 0.4 | 35.6 | 9.81% |
| AC3644 | CD3.213 | L5V, K19R, A49G, N54D, D65G, N82bE | 17 | 26 | 3280.0 | 1.2 | 6.6 | 57.91% |
| AC3645 | CD3.214 | L5V, K19R, N30S, A49G, N54D, D65G, N82bE | 17 | 26 | 3420.0 | 1.3 | 6.6 | 67.42% |
| AC3646 | CD3.215 | L5V, K19R, N30S, A49G, Y52cR, D65G, N82bS | 9 | 18 | 2020.0 | 0.8 | 9.7 | 54.85% |
| AC3647 | CD3.216 | L5V, K19R, N30S, A49G, Y52cT, D65G, N82bS | 10 | 19 | 2100.0 | 0.8 | 11.2 | 61.45% |
| AC3648 | CD3.217 | L5V, K19R, N30S, A49G, N54D, D65G, N82bS | 10 | 19 | 1040.0 | 0.4 | 10.7 | 31.11% |
| AC3649 | CD3.218 | L5V, K19R, N30S, A49G, Y58T, D65G, N82bS | 12 | 21 | 800.0 | 0.3 | 52.6 | 3.83% |
| AC3650 | CD3.219 | L5V, K19R, A49G, S52aT, Y52cR, D65G, N82bE | 10 | 17 | 2010.0 | 0.8 | 4.7 | 57.93% |

TABLE 23b-continued

| | | | | | | | | |
|---|---|---|---|---|---|---|---|---|
| AC3651 | CD3.220 | L5V, K19R, N30S, A49G, S52aT, Y52cR D65G, N82bE | 10 | 17 | 1950.0 | 0.7 | 4.8 | 63.19% |
| AC3652 | CD3.221 | L5V, K19R, A49G, S52aT, Y52cT, D65G, N82bE | 15 | 22 | 2600.0 | 1.0 | 11.7 | 5.17% |
| AC3653 | CD3.222 | L5V, K19R, N30S, A49G, S52aT, Y52cT, D65G, N82bE | 15 | 22 | 2440.0 | 0.9 | 10.8 | 33.59% |
| AC3654 | CD3.223 | L5V, K19R, A49G, S52aT, N54D, D65G, N82bE | 17 | 24 | 2890.0 | 1.1 | 6.0 | 68.99% |
| AC3655 | CD3.224 | L5V, K19R, N30S, A49G, S52aT, N54D, D65G, N82bE | 17 | 24 | 2530.0 | 1.0 | 6.4 | 52.55% |
| AC3656 | CD3.225 | L5V, K19R, A49G, S52aT, Y58T, D65G, N82bE | 19 | 26 | 3110.0 | 1.0 | 19.5 | 37.24% |
| AC3657 | CD3.226 | L5V, K19R, N30S, A49G, S52aT, Y58T, D65G, N82bE | 19 | 26 | 1320.0 | 0.4 | 50.9 | 8.94% |
| AC3658 | CD3.227 | L5V, K19R, A49G, S52aT, Y52cR, D65G, N82bS | 3 | 10 | 2850.0 | 1.0 | 8.2 | 62.96% |
| AC3659 | CD3.228 | L5V, K19R, N30S, A49G, S52aT, Y52cR, D65G, N82bS | 3 | 10 | 2750.0 | 0.9 | 6.2 | 80.86% |
| AC3660 | CD3.229 | L5V, K19R, A49G, | 8 | 15 | 3310.0 | 1.1 | 11.9 | 51.28% |

TABLE 23b-continued

| | | | | | | | | |
|---|---|---|---|---|---|---|---|---|
| | | S52aT, Y52cT, D65G, N82bS | | | | | | |
| AC3661 | CD3.230 | L5V, K19R, N30S, A49G, S52aT, Y52cT, D65G, N82bS | 8 | 15 | 2740.0 | 0.9 | 17.0 | 62.00% |
| AC3662 | CD3.231 | L5V, K19R, A49G, S52aT, N54D, D65G, N82bS | 10 | 17 | 3590.0 | 1.2 | 5.1 | 54.69% |
| AC3663 | CD3.232 | L5V, K19R, N30S, A49G, S52aT, N54D, D65G, N82bS | 10 | 17 | 3890.0 | 1.3 | 5.1 | 74.10% |
| AC3664 | CD3.233 | L5V, K19R, A49G, S52aT, Y58T, D65G, N82bS | 12 | 19 | 3310.0 | 1.1 | 24.9 | 15.01% |
| AC3665 | CD3.234 | L5V, K19R, N30S, A49G, S52aT, Y58T, D65G, N82bS | 12 | 19 | 3310.0 | 1.1 | 17.4 | 13.49% |
| AC3666 | CD3.235 | L5V, K19R, A49G, N54E, D65G, N82bS | 14 | 23 | 3620.0 | 1.2 | 6.5 | 63.15% |
| AC3667 | CD3.236 | L5V, K19R, A49G, D65G, N82bS | 8 | 17 | 3180.0 | 1.1 | 21.9 | 0.65% |
| AC3668 | CD3.237 | L5V, K19R, A49G, D65G, N82bS | 15 | 24 | 690.0 | 0.3 | 22.2 | 0 |
| AC3669 | CD3.238 | L5V, K19R, S52aT, Y58T, N82bS | 16 | 23 | 1680.0 | 0.7 | 23.1 | −5.55% |
| AC3670 | CD3.239 | L5V, K19R, Y52cR, Y58T, N82bS | 14 | 21 | 1590.0 | 0.7 | 29.9 | −12.81% |

TABLE 23b-continued

| | | | | | | | | |
|---|---|---|---|---|---|---|---|---|
| AC3671 | CD3.240 | L5V, K19R, Y52cK, Y58T, N82bS | 16 | 23 | 1790.0 | 0.7 | 16.5 | −25.28% |
| AC3672 | CD3.241 | L5V, K19R, Y52cT, Y58T, N82bS | 14 | 21 | 2280.0 | 0.9 | 92.6 | −183.07% |
| AC3673 | CD3.242 | L5V, K19R, A49G, N54D, D65G, V78L, N82bS | 9 | 18 | 2620.0 | 1.1 | 7.7 | 34.70% |
| AC3674 | CD3.243 | L5V, K19R, A49G, N54E, D65G, V78L, N82bS | 13 | 32 | ND | ND | ND | ND |
| AC3675 | CD3.244 | L5V, K19R, A49G, D65G, V78L, N82bS | 7 | 16 | 740.0 | 0.3 | 43.6 | −43.16% |
| AC3676 | CD3.245 | L5V, K19R, A49G, D65G, V78L, N82bE | 17 | 26 | 2490.0 | 1.0 | 19.3 | −65.26% |
| AC3677 | CD3.246 | L5V, K19R, S52aT, Y58T, V78L, N82bS | 15 | 22 | 1970.0 | 0.8 | 35.2 | −0.10% |
| AC3678 | CD3.247 | L5V, K19R, Y52cR, Y58T, V78L, N82bS | 13 | 20 | 1880.0 | 0.8 | 28.9 | −59.35% |
| AC3679 | CD3.248 | L5V, K19R, Y52cK, Y58T, V78L, N82bS | 15 | 22 | 1700.0 | 0.7 | 49.2 | −25.51% |
| AC3680 | CD3.249 | L5V, K19R, Y52cT, Y58T, V78L, N82bS | 13 | 20 | 3180.0 | 1.0 | 128.0 | −193.59% |
| AC3681 | CD3.250 | L5V, K19R, A49G, S52aT, Y58T, N82bS | 12 | 19 | 2950.0 | 0.9 | 31.0 | −5.62% |
| AC3682 | CD3.251 | L5V, K19R, A49G, | 8 | 17 | 2730.0 | 0.9 | 32.88 | 11.12% |

TABLE 23b-continued

| | | | | | | | | |
|---|---|---|---|---|---|---|---|---|
| | | Y52cR, Y58T, N82bS | | | | | | |
| AC3683 | CD3.252 | L5V, K19R, A49G, Y52cK, Y58T, N82bS | 9 | 19 | 2280.0 | 0.7 | 22.9 | −13.59% |
| AC3684 | CD3.253 | L5V, K19R, A49G, Y52cT, Y58T, N82bS | 10 | 19 | 2900.0 | 0.9 | 79.9 | −105.16% |
| AC3685 | CD3.254 | L5V, K19R, A49G, S52aT, Y58T, N82bE | 19 | 26 | 2650.00 | 0.8 | 32.3 | 24.18% |
| AC3686 | CD3.255 | L5V, K19R, A49G, Y52cR, Y58T, N82bE | 15 | 24 | 2110.0 | 0.7 | 22.4 | 32.47% |
| AC3687 | CD3.256 | L5V, K19R, A49G, Y52cK, Y58T, N82bE | 16 | 26 | ND | ND | ND | ND |
| AC3688 | CD3.257 | L5V, K19R, A49G, Y52cT, Y58T, N82bE | 17 | 26 | 2970.0 | 0.9 | 159.0 | −92.57% |
| AC3689 | CD3.258 | L5V, K19R, A49G, S52aT, Y58T, V78L, N82bS | 11 | 18 | 2840.0 | 0.9 | 38.0 | 22.13% |
| AC3690 | CD3.259 | L5V, K19R, A49G, Y52cR, Y58T, V78L, N82bS | 7 | 16 | 2540.0 | 0.8 | 29.4 | 14.38% |
| AC3691 | CD3.260 | L5V, K19R, A49G, Y52cK, Y58T, V78L, N82bS | 8 | 18 | 2730.0 | 0.9 | 45.6 | 27.07% |
| AC3692 | CD3.261 | L5V, K19R, A49G, Y52cT, Y58T, V78L, N82bS | 9 | 18 | 2200.0 | 0.9 | 97.0 | −122.00% |
| AC3693 | CD3.262 | L5V, K19R, | 17 | 26 | 2100.0 | 0.9 | 25.4 | −4.58% |

TABLE 23b-continued

|  |  |  |  |  |  |  |  |
|---|---|---|---|---|---|---|---|
|  |  | A49G, Y52cR, Y58T, V78L, N82bE |  |  |  |  |  |  |
| AC3694 | CD3.263 | L5V, A49G, S52aT, Y52cR, D65G, N82bS | 17 | 26 | 2050.0 | 0.8 | 7.2 | 53.06% |
| AC3695 | CD3.264 | L5V, N30S, A49G, S52aT, Y52cR, D65G, N82bS | 17 | 26 | 2500.0 | 1.0 | 4.5 | 55.56% |
| AC3471 | CD3.23 | WT | 50 | 73 | 2738.0 | 1.0 | 13.5 | 63.73% |
| AC3432* | CD3.103 | A49G, Y52cG, D65G, N82bS | 8 | 33 | 3843.3 | 1.3 | 13.5 | 21.44% |
| AC2717* | CD3.23 | WT | 50 | 73 | 3723.3 | 1.3 | 12.9 | 73.42% |

*AC3432 and AC2717 paired with PSMA.5.
**These values are arbitrary reads from the Octet data. A higher number means more protein is presented.
***These values are ratios compared to expression level of CD3.23. Higher ration means higher expression level compared to expression of CD3.23.

Example 7. Release Site Engineering

Incubation of a paTCE comprising RSR-2295 in human plasma showed some cleavage that, though not high, was unexpected. Further investigation revealed that the cleavage was surprisingly due to legumain, which has previously believed to be specifically present in tumor tissues. Additionally, it was initially believed that legumain cleavage provided meaningful levels of paTCE activation in tumor tissues.

A new release site was designed to avoid cleavage by legumain, resulting in RSR-3213. Surprisingly, a paTCE containing RSR-3213 release sequences was cleaved less in plasma but at comparable amounts to a corresponding paTCE comprising RSR-2295 release sequences in multiple tumor types (including gastric carcinoma (NCI-N87), colorectal adenocarcinoma (HT-29), colon carcinoma (HT-55) tumors). Thus, paTCEs comprising RSR-3213 have enhanced specificity for tumor tissues without a significant loss of activation in tumor tissues.

Figure 7B:
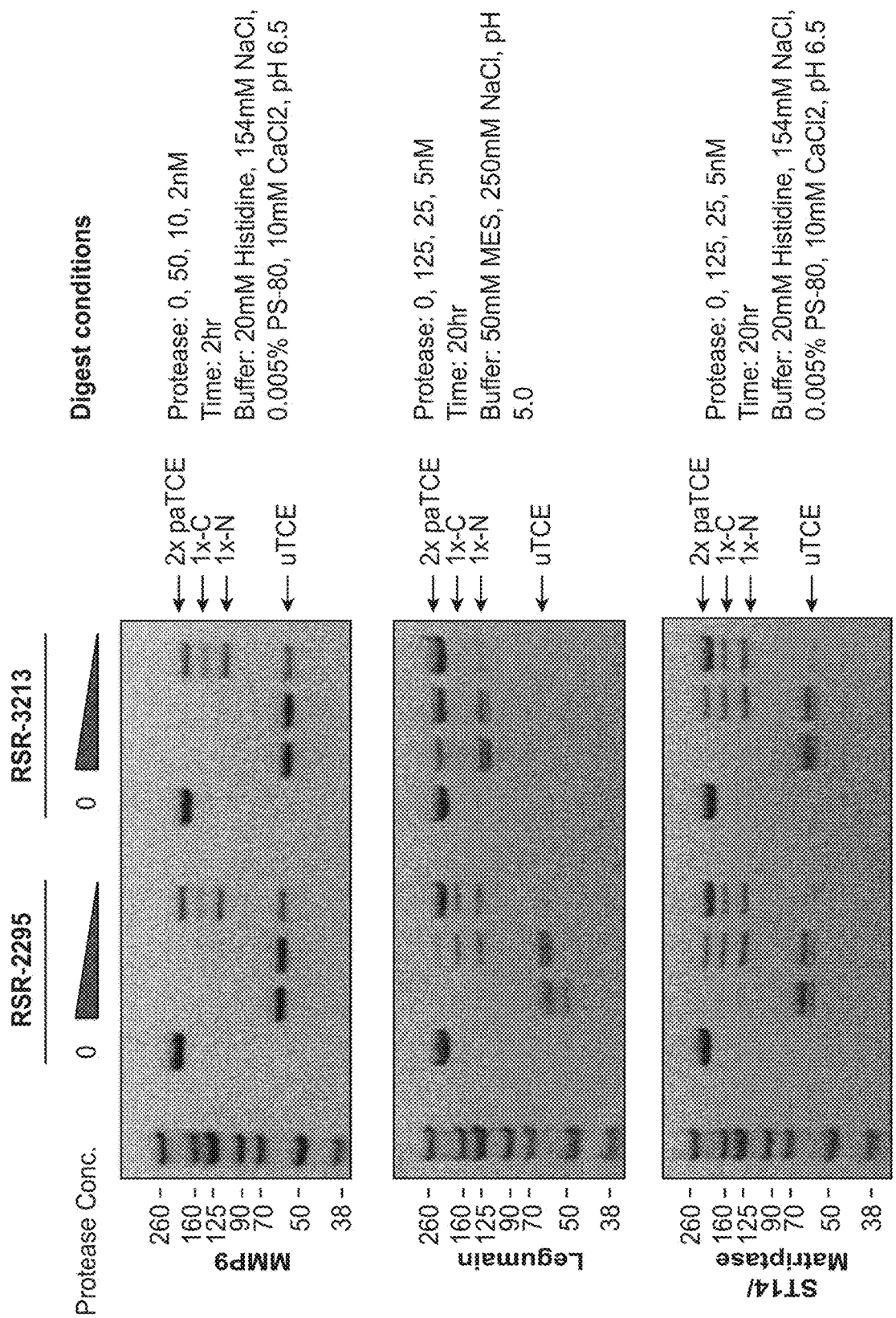
FIG. 7B depicts in vitro protease digestion of paTCEs employing RSR-2295 or RSR-3213. The RSR-3213 sequence is modified to substantially reduce cleavage by legumain.

In Vitro Digest:

In vitro digest assays were performed to demonstrate that RSR-3213 is cleaved by MMP and ST14/matriptase, but not legumain. Two EpCAM-targeting paTCE (EpCAM-paTCE) molecules (one of having RSR-2295 on both sides of the TCE, and the other having RSR-3213 on both sides of the TCE) flanking the TCE core were digested with 5-fold dilutions of MMP9, legumain, or ST14/matriptase. Similar banding patterns were observed for both MMP9 and matriptase, suggesting the mutation of the legumain cleavage site did not affect cleavability of the MMP and serine protease cleavage sites. uTCE was observed for the paTCE containing RSR-2295 after digestion with legumain, indicating cleavage at the protease cleavable linker by legumain. uTCE was not observed for the paTCE containing RSR-3213 after digestion with legumain, indicating the mutation successfully prevented cleavage at the protease cleavable linker by legumain (FIG. 7A and FIG. 7B).

Plasma Stability—In Vivo Cleavability

Figure 8A:
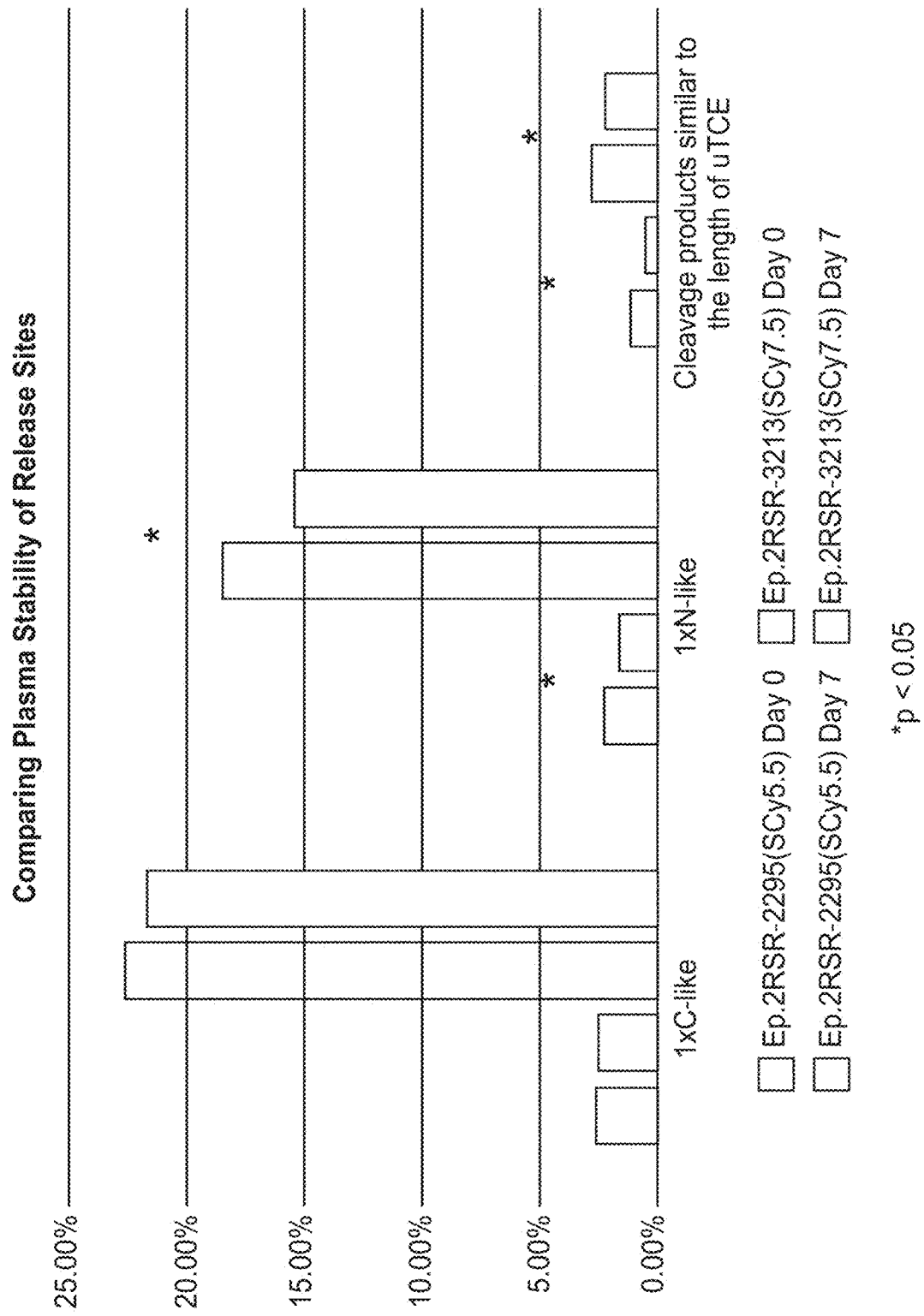

Fluorescently labeled variants of an EpCAM-paTCE containing either RSR-2295 or RSR-3213 were labeled with Sulfo-Cy5.5 or Sulfo-Cy7.5. Opposite colors were co-injected into mice containing NCI-N87, HT-29, or HT-55 xenograft tumors. 48 hours after injection, tumors were harvested, homogenized, and protein extracts were analyzed by SDS-PAGE and LI-COR. Relative abundances for paTCE, 1x-C, 1x-N, and uTCE were quantified. No significant differences were observed in uTCE and 1x-C between the two protease cleavable linkers. paTCE containing RSR-2295 showed a small but statistically significant increase (average 2.19% more) in 1x-N than the corresponding paTCE containing RSR-3213. (FIG. 8A and FIG. 8B).

Figure 8C:
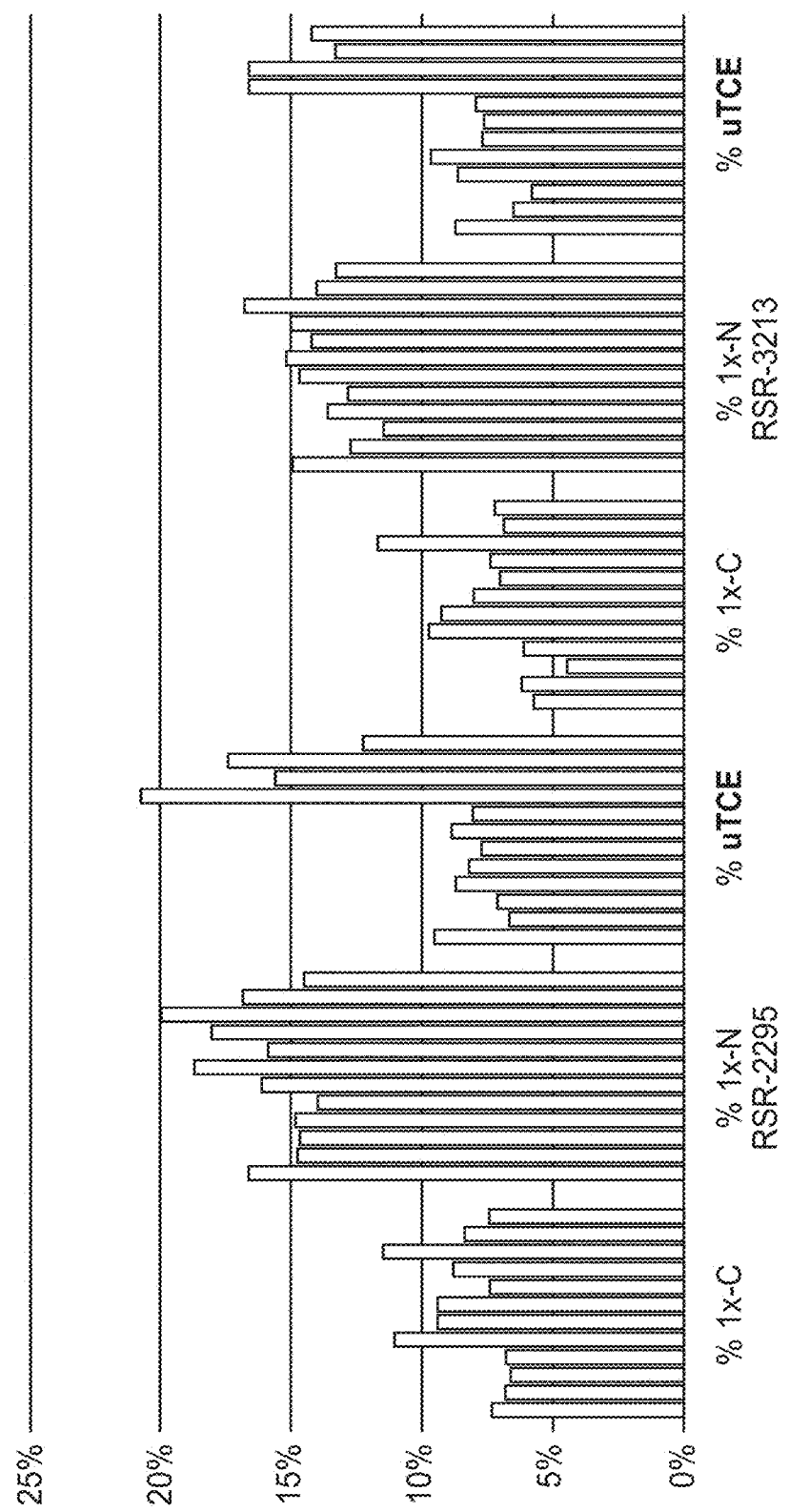
FIG. 8C depicts the observed cleavability in vivo from tumor homogenates from 3 different mouse tumor models. For each set of bar graphs (i.e., % 1x-C, % 1x-N, % uTCE), each bar from left to right represents B1, B2, B3, B4, A1, A2, A3, A4, 43-1, 43-2, 43-3, and 43-4. B1-B4 represent 4 different mice from a first tumor model (NCI-N87). A1-A4 represent 4 different mice from a second tumor model (HT-29). 43-1-43-4 represent 4 different mice from a third tumor model (HT-55).
Figure 8D:
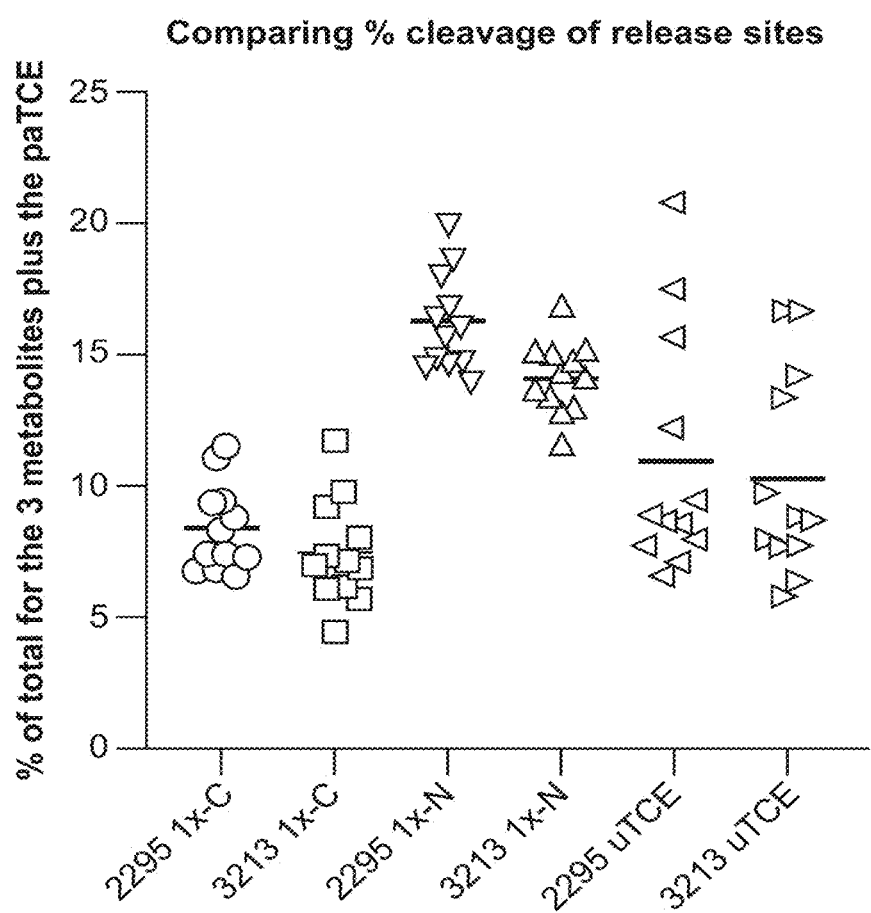
FIG. 8D depicts the % of total for the 3 metabolites plus the paTCE (paTCE, 1x-N, 1x-C, and uTCE) when employing RSR-2295 or RSR-3213.

The observed cleavability in vivo from tumor homogenates was also determined from 3 different mouse tumor models. The % abundance for metabolites 1x-C, 1x-N, and uTCE was measured with results depicted in FIG. 8C. Finally, FIG. 8D depicts the % of total for paTCE plus the 3 metabolites (1x-N, 1x-C, and uTCE) when employing RSR-2295 or RSR-3213.

Overall, these data suggest that differences between in vivo cleavability of RSR-2295 and RSR-3213 are minor across 3 different tumor models.

Figure 9:
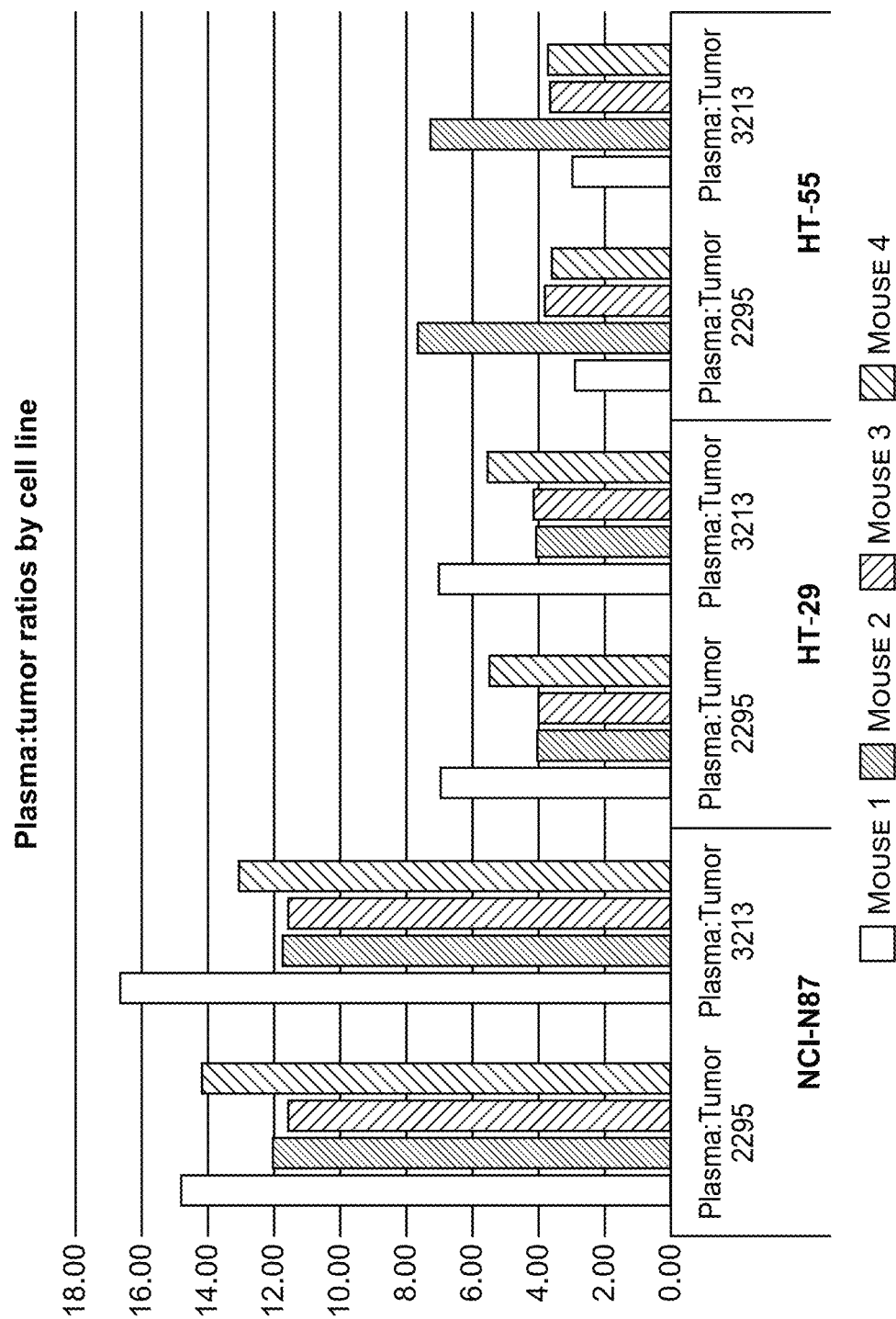
FIG. 9 depicts relative tumor uptake of paTCEs employing RSR-2295 or RSR-3213. The plasma: tumor ratio was calculated in 3 different mouse tumor models (4 mice per tumor model). There is a "Mouse 1" for each of the 3 different tumor models, a "Mouse 2" for each of the 3 different tumor models, a "Mouse 3" for each of the different tumor models, and a "Mouse 4" for each of the 3 different tumor models.

Tumor Uptake:

Tumor uptake between EpCAM-paTCEs containing either RSR-2295 or RSR-3213 were compared using the ratio of calculated concentrations of total drug (paTCE, 1x-C, 1x-N, and uTCE). While differences in tumor uptake were observed across 3 different tumor models, no significant differences were observed between RSR-2295 and RSR-3213 within each model. This indicates that the changes to the protease cleavable linkers between RSR-2295 and RSR-3213 do not affect tumor uptake of paTCE (FIG. 9).

Example 8. AMX-500, an Exemplary PSMA-Targeting Protease-Activated TCE

This example provides data relating to an exemplary paTCE, referred to as AMX-500.

Method of Production of AMX-500

Methods for producing paTCEs proteins are known in the art, e.g., as described in PCT International Patent Publication No. WO2017/040344. For example, paTCE was expressed in *E. coli*, which was transformed with an expression vector encoding the paTCE and grown in fermentation. Fermentation cultures were grown with animal-free complex medium at 37° C. and temperature shifted to 26° C. before phosphate depletion, which triggered induction (PhoA). Target protein was partitioned into the periplasm via an N-terminal secretory leader sequence, which was cleaved during translocation. During harvest, fermentation whole broth was centrifuged to pellet the product-containing cells, which were retained and frozen at ≤−70° C. The frozen cell pellet was resuspended and, once homogenous, the resuspension was mechanically lysed and refrigerated. The chilled lysate was centrifuged (12,000 RCF, 10° C., 30 min) and the supernatant was decanted and retained, while the pellet was discarded. The following day, centrifugation was performed again (12,000 RCF, 10° C., 30 min) and the supernatant was decanted, submicron filtered and purified via a chromatographic process comprising an Anion Exchange (AEX) chromatography step. paTCE proteins and their derivatives were prepared as aqueous solutions and stored frozen at ≤−70° C. and, after thawing, at temperatures between 2° C. and 8° C.

An exemplary nucleotide sequence for the production of AMX-500 is provided below:

```
                                        (SEQ ID NO: 9000)
GCATCTTCGGCGACGCCGGAAAGCGGTCCGGGTACGTCCACCGAACCGA

GCGAGGGTAGCGCTCCGGGCACCAGCGAGTCCGCGACCCCGGAAAGCGG

TCCGGGTAGCGGTCCGGGCACCTCCGAGAGCGCGACCCCGGGCACCTCT

GAATCAGCCACCCCGGAGTCTGGCCCAGGTAGCGAGCCGGCAACCTCTG

GCAGCGAAACCCCGGGCACCAGCGAATCCGCGACGCCAGAGAGCGGTCC

GGGCACCTCTACGGAGCCTAGCGAGGGCTCAGCACCAGGTAGCCCTGCA

GGTTCCCCGACGTCAACCGAGGAAGGTACAAGCGAAAGCGCCACCCCTG

AGTCGGGCCCTGGCAGCGAACCGGCAACTAGCGGCAGCGAGACTCCGGG

TACCAGCGAGTCTGCTACGCCAGAGAGCGGCCCAGGTTCGCCAGCGGGT

TCGCCGACTAGCACGGAGGAGGGCAGCCCAGCGGGTAGCCCTACCAGCA

CTGAAGAGGGTACGTCCACCGAACCGAGCGAAGGTAGCGCACCAGGTAC

CTCCGAGTCTGCCACCCCTGAATCCGGTCCAGGTACCAGCGAATCAGCC

ACCCCGGAGTCGGGTCCAGGTACGAGCGAATCTGCTACCCCGGAATCCG

GCCCAGGCAGCGAACCTGCTACTAGCGGCAGCGAAACGCCGGGCAGCGA

ACCTGCCACGTCAGGCAGCGAGACGCCGGGTTCCCCTGCAGGCTCCCCG

ACCAGCACTGAGGAGGGCACCTCCACCGAACCATCAGAAGGTAGCGCGC
```

```
-continued
CTGGTACGTCAACCGAACCTTCCGAGGGCAGCGCACCGGGTTCAGAACC

AGCTACGTCTGGGAGCGAGACCCCGGGCACCTCCGAGTCGGCGACCCCG

GAGGCAGGTCGTTCTGCTAGCCATACCCCTGCAGGGTTAACTGGCCCCG

GAACTTCAGAAAGTGCTACACCCGAGTCTCAGGTTCAACTGGTGGAGAG

CGGTGGCGGTGTGGTTCAGCCGGGTCGTAGCCTGCGTCTGAGCTGCGCG

GCGAGCGGTCGTACCTTTGGTATCTATGTGTGGGGTTGGTTTCGTCAGG

CGCCGGGCAAGGAGCGTGAATTCGTGGGCGCGATGAGCTGGAGCGGTAG

CAACCGTAAAGTGAGCGACAGCGTTAAGGGCCGTTTTACCATTAGCCGT

GATAACAGCAAAAACACCCTGTACCTGCAAATGAACAGCCTGCGTGCGG

AGGACACCGCGGTTTACTATTGCGCGGCGAGCAACAAAGAATATGGCCG

TACCTGGTATGATTTCAATGAGAGCGACTACTGGGGCCAAGGCACCCAA

GTGACCGTTAGCAGCGGGGGAGGCGGAAGTGGTGGAGGGTCAGAGTTAG

TTGTGACCCAAGAGCCGAGCCTGACCGTTAGCCCGGGTGGTACGGTCAC

CCTGACGTGCCGTAGCAGCAACGGTGCGGTCACGAGCAGCAACTATGCC

AATTGGGTCCAGCAGAAACCGGGTCAAGCACCGCGTGGCCTGATCGGCG

GCACCAATAAACGTGCCCCGGGTACTCCTGCGCGTTTCTCCGGTAGCCT

GCTGGGCGGCAAAGCCGCTCTGACCCTGAGCGGTGTCCAGCCGGAAGAT

GAAGCGGTGTACTACTGCGCGCTGTGGTATCCGAATCTGTGGGTTTTTG

GCGGCGGTACCAAGCTGACCGTATTGAGCGAGAGCGCAACGCCAGAGAG

CGGTCCAGGCACCAGCCCAGGTGCCACCCCTGAGAGCGGCCCAGGTACT

TCTGAGAGCGCCACTCCGGAGGTCCAACTGGTGGAGTCTGGTGGTGGCA

TTGTTCAACCGGGTGGCTCGTTGCGCCTGAGCTGTGCAGCTAGCGGCTT

TACCTTCAGCACCTATGCGATGAATTGGGTTCGTCAGGCACCGGGTAAG

GGCCTGGAATGGGTGGCCGTATCCGCACCAAGCGCAACAACTACGCGA

CCTACTACGCGGATAGCGTTAAAGGCCGCTTCACGATTAGCCGTGACGA

TTCCAAGAATACGGTGTATCTGCAAATGAACAGCCTGAAAACCGAAGAT

ACCGCGGTGTATTACTGTGTGCGCCACGAAAATTTCGGCAACAGCTACG

TGAGCTGGTTTGCACATTGGGGTCAGGGCACCCTGGTTACGGTGAGCTC

CGGTACAGCTACTCCAGAATCAGGACCCGGGGAAGCTGGAAGAAGCGCC

TCACACACACCAGCTGGACTTACAGGCCCGGCTACTCCCGAAAGTGGGC

CAGGAACATCAGAGTCCGCGACCCCGGAAAGCGGTCCGGGTTCTCCAGC

TGGCAGCCCGACCTCCACTGAAGAAGGCACCTCTGAGTCTGCTACCCCT

GAATCTGGTCCTGGCTCCGAACCTGCTACCTCTGGTTCCGAAACTCCAG

GTACCTCGGAATCTGCGACTCCGGAATCTGGCCCGGGCACGAGCACGGA

GCCGTCTGAGGGTAGCGCACCAGGTACCAGCACTGAGCCTTCTGAGGGC

TCTGCACCGGGTACCTCCACGGAACCTTCGGAAGGTTCTGCGCCGGGTA

CCTCCACTGAGCCATCCGAGGGTTCAGCACCAGGTACTAGCACGGAACC

GTCCGAGGGCTCTGCACCAGGTACGAGCACCGAACCGTCGGAGGGTAGC

GCTCCAGGTAGCCCAGCGGGCTCTCCGACAAGCACCGAAGAAGGCACCA

GCACCGAGCCGTCCGAAGGTTCCGCACCAGGTACAAGCGAGAGCGCGAC

TCCTGAATCTGGTCCGGGTAGCGAGCCTGCAACCAGCGGTTCTGAGACG
```

-continued

```
CCGGGCACTTCCGAATCTGCGACCCCGGAGTCCGGTCCAGGTTCAGAGC
CGGCGACGAGCGGTTCGGAAACGCGGGTACGTCTGAATCAGCCACGCC
GGAGTCTGGTCCGGGTACCTCGACCGAACCAAGCGAAGGTTCGGCACCG
GGTACTAGCGAGAGCGCAACCCCTGAAAGCGGTCCGGGCAGCCCGGCAG
GTTCTCCAACCAGCACCGAAGAAGGTTCCCCTGCTGGTAGCCCGACCTC
TACGGAGGAAGGTAGCCCTGCAGGTTCCCCAACTTCTACTGAGGAAGGT
ACTTCTGAGTCCGCTACCCCAGAAAGCGGTCCTGGTACCTCCACTGAAC
CGTCTGAAGGCTCTGCACCAGGCACTTCTGAGTCTGCTACTCCAGAAAG
CGGCCCAGGTTCTGAACCAGCAACTTCTGGCTCTGAGACTCCAGGCACT
TCTGAGTCCGCAACGCCTGAATCCGGTCCTGGTTCTGAACCAGCTACTT
CCGGCAGCGAAACCCCAGGTACCTCTGAGTCTGCGACTCCAGAGTCTGG
TCCTGGTACTTCCACTGAGCCTAGCGAGGGTTCCGCACCAGGTTCTCCG
GCTGGTAGCCCGACCAGCACGGAGGAGGGTACGTCTGAATCTGCAACGC
CGGAATCGGGCCCAGGTTCGGAGCCTGCAACGTCTGGCAGCGAAACCCC
GGGTACCTCCGAATCTGCTACACCGGAAAGCGGTCCTGGCAGCCCTGCT
GGTTCTCCAACCTCTACCGAGGAGGGTTCACCGGCAGGTAGCCCGACTA
GCACTGAAGAAGGTACTAGCACGGAGCCGAGCGAGGGTAGTGCTCCGGG
TACGAGCGAGAGCGCAACGCCAGAGAGCGGTCCAGGCACCAGCGAATCG
GCCACCCCTGAGAGCGGCCCAGGTACTTCACCCTCTGCTACGCCGGAAA
GCGGTCCGGGTTCCGAGCCGGCGACCAGCGGCTCCGAGACTCCGGGTTC
GGAGCCGGCGACCTCCGGCTCGGAAACCCCGGGTAGCCCGGCTGGTTCT
CCGACCAGCACTGAGGAAGGCACCAGCACCGAACCAAGCGAGGGCAGCG
CGCCAGGTACGAGCACCGAACCGAGCGAGGGTTCAGCCCCTGGCTCTGA
GCCGGCGACGTCTGGCTCCGAAACCCCGGGCACCAGCGAGAGCGCTGGT
GAACCGGAAGCG.
```

In Vitro Data, Including Cytotoxicity, In Vitro CRA and T-Cell Activation

Figure 11A:
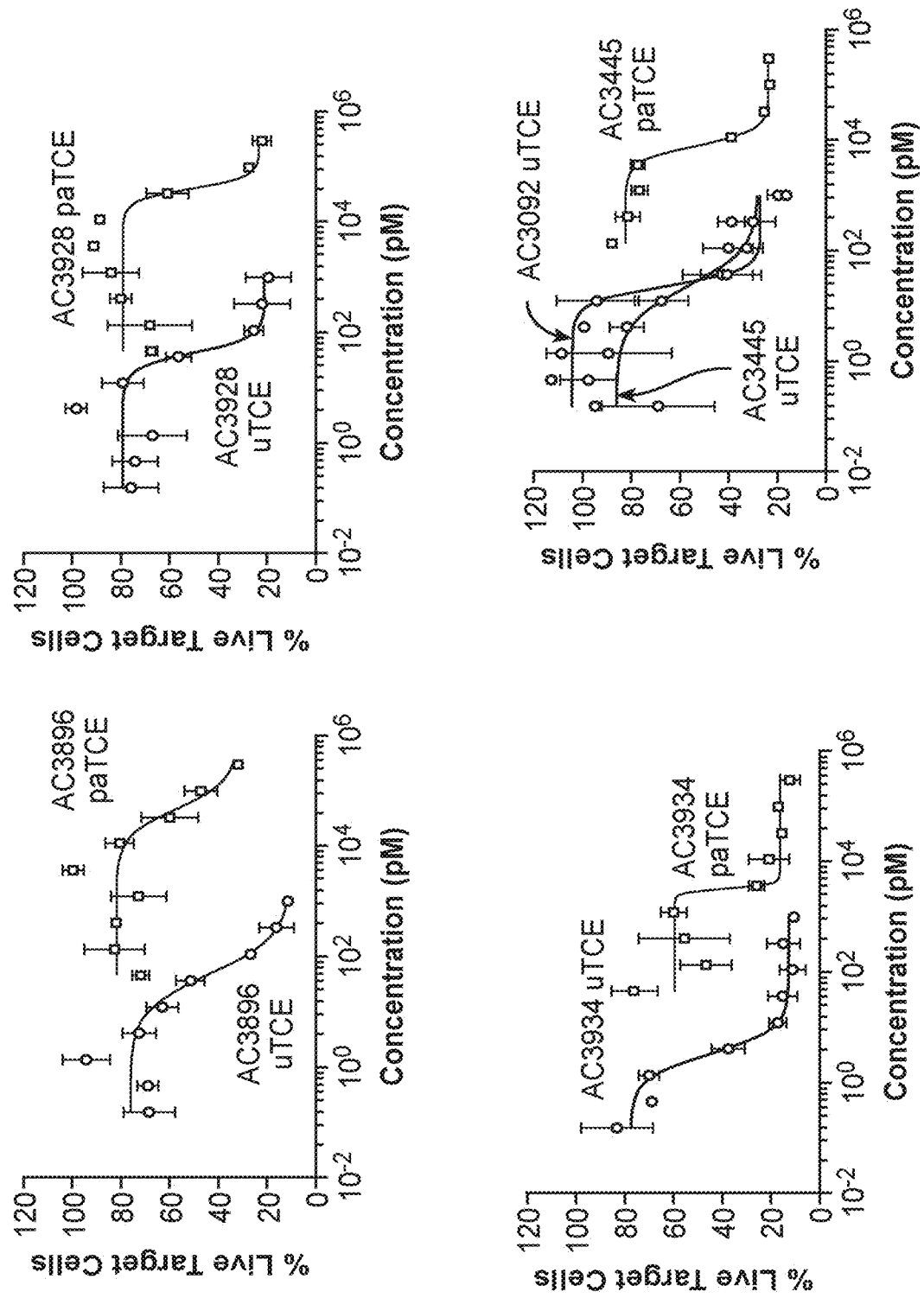
FIG. 11A and FIG. 11B depict dose response curves of relative in vitro cytotoxicity of LNCaP PSMA$^{high}$ cells (FIG. 11A) and 22Rv1 PSMA$^{low}$ cells (FIG. 11B).
Figure 11B:
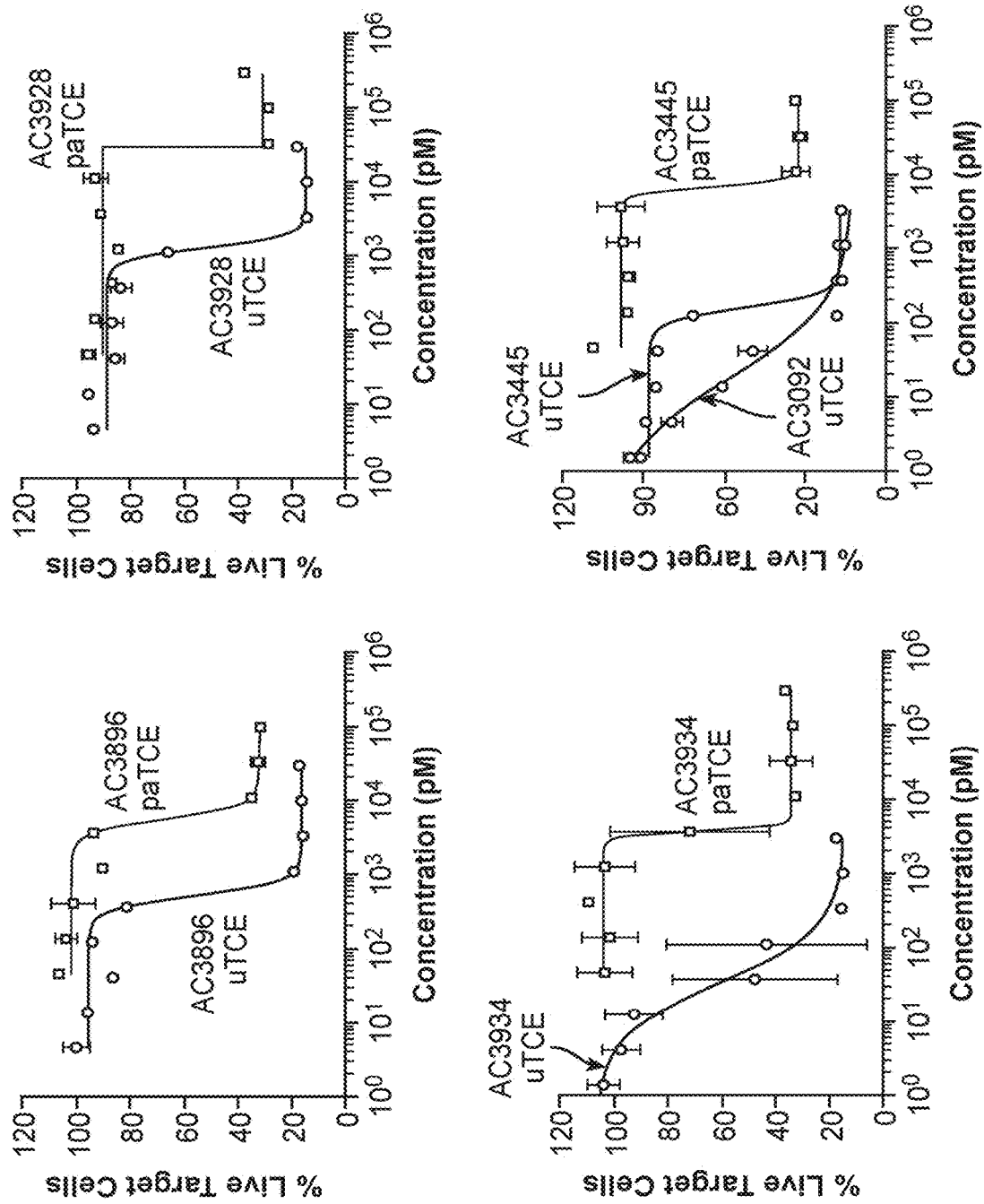

In vitro cytotoxicity of PSMA-paTCE leads were screened using either LNCaP or 22Rv1 cell lines in an Effector to Target (E:T) ratio of 10 to 1. Unmasked PSMA-paTCE (PSMA-uTCE) leads had a EC50 value between 1 pM to 100 pM in LnCaP cell line (see Table 24 below). Unmasked PSMA-paTCE (PSMA-uTCE) leads had a EC50 value between 1 pM to 2000 pM in 22Rv1 cell line (see Table 25 below). Various linker lengths between TAA and CD3 domains have been evaluated in the in vitro cytotoxicity assay using LNCaP cell line which have EC50 ranged from 1 pM to 50 pM. Different orientation of heavy and light CD3 domains were screened which have EC50 between 1 µM to 50 pM. PSMA-paTCE AMX-500 has an EC50 ranged from 35000 pM to 90000 pM in the LnCaP cell line. The AMX-500(1x-N) metabolite of PSMA-paTCE AMX-500 has an EC50 ranged from 5000 pM to 8000 pM in the LnCaP cell line. The AMX-500(1x-C) metabolite of PSMA-paTCE AMX-500 has an EC50 ranged from 6000 pM to 12000 pM in the LnCaP cell line. Fully unmasked AMX-500(uTCE) has an EC50 ranged from 15 pM to 35 pM in the LnCaP cell line. PSMA-paTCE AMX-500, AMX-500(1x-N) and AMX-500(1x-C) did not exhibit any cytotoxic activity up to 1 µM in the 22Rv1 cell line. Fully unmasked AMX-500(uTCE) has an EC50 ranged from 600 pM to 1500 pM in 22Rv1 cell line (see FIG. 11A-FIG. 11B for dose response curves).

TABLE 24 in vitro cytotoxicity assay EC50 values in the LnCaP cell line

| uTCE | uTCE | Masked paTCE | uTCE | Masked paTCE | uTCE | Masked paTCE | uTCE | Masked paTCE |
|---|---|---|---|---|---|---|---|---|
| PSMA.5-CD3.23 | PSMA.119-CD3.23 | | PSMA.350-CD3.228 | | PSMA.350-CD3.23 | | PSMA.262-CD3.228 | |
| AC3092 | AC3445 | AC3445 | AC3896 | AC3896 | AC3928 | AC3928 | AC3934 | AC3934 |
| 20 pM | 22 pM | 7,909 pM | 49 pM | 46,806 pM | 43 pM | 188,626 pM | 3 pM | ND |

TABLE 25 in vitro cytotoxicity assay EC50 values in the 22Rv1 cell line

| uTCE | uTCE | Masked paTCE | uTCE | Masked paTCE | uTCE | Masked paTCE | uTCE | Masked paTCE |
|---|---|---|---|---|---|---|---|---|
| PSMA.5-CD3.23 | PSMA.119-CD3.23 | | PSMA.350-CD3.228 | | PSMA.350-CD3.23 | | PSMA.262-CD3.228 | |
| AC3092 | AC3445 | AC3445 | AC3896 | AC3896 | AC3928 | AC3928 | AC3934 | AC3934 |
| 18 pM | 160 pM | 6896 pM | 523 pM | 5640 pM | 1294 pM | ND | 34 pM | 3753 PM |

Figure 12A:
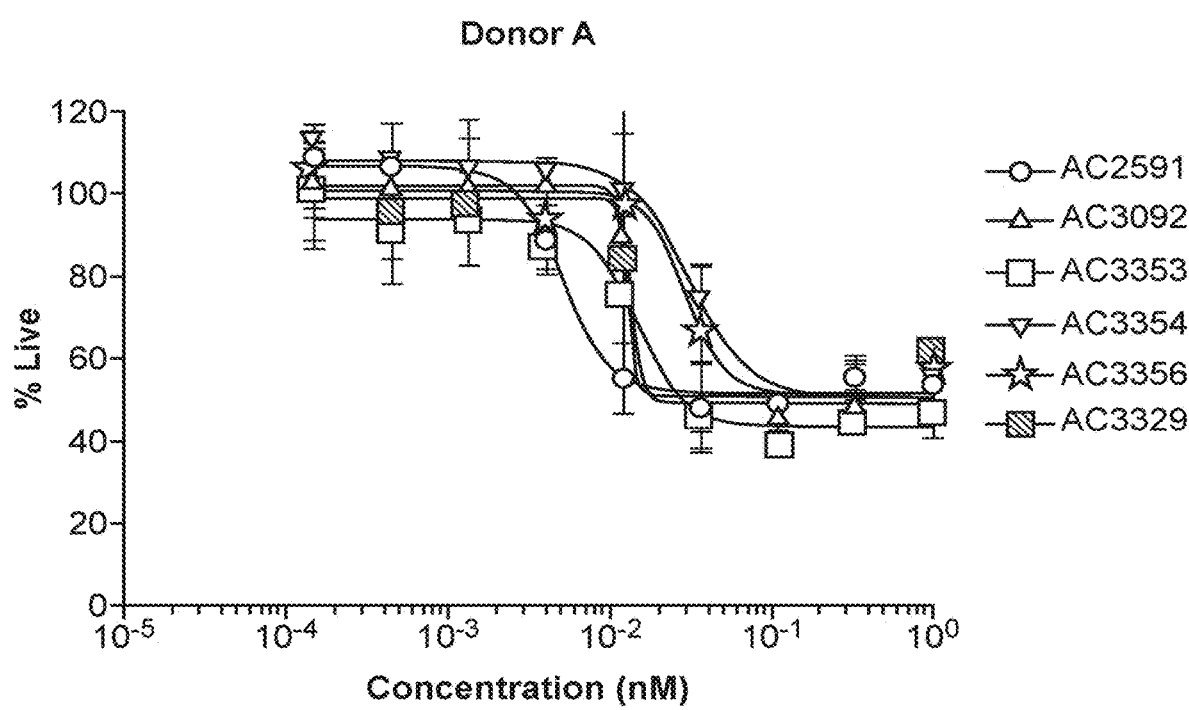
FIG. 12A-FIG. 12C depict dose response curves of relative in vitro cytotoxicity of LNCaP PSMA$^{high}$ cells (FIG. 12A and FIG. 12B) and 22Rv1 PSMA$^{low}$ cells (FIG. 12C) with 3 different donor human PBMC samples.
Figure 12B:
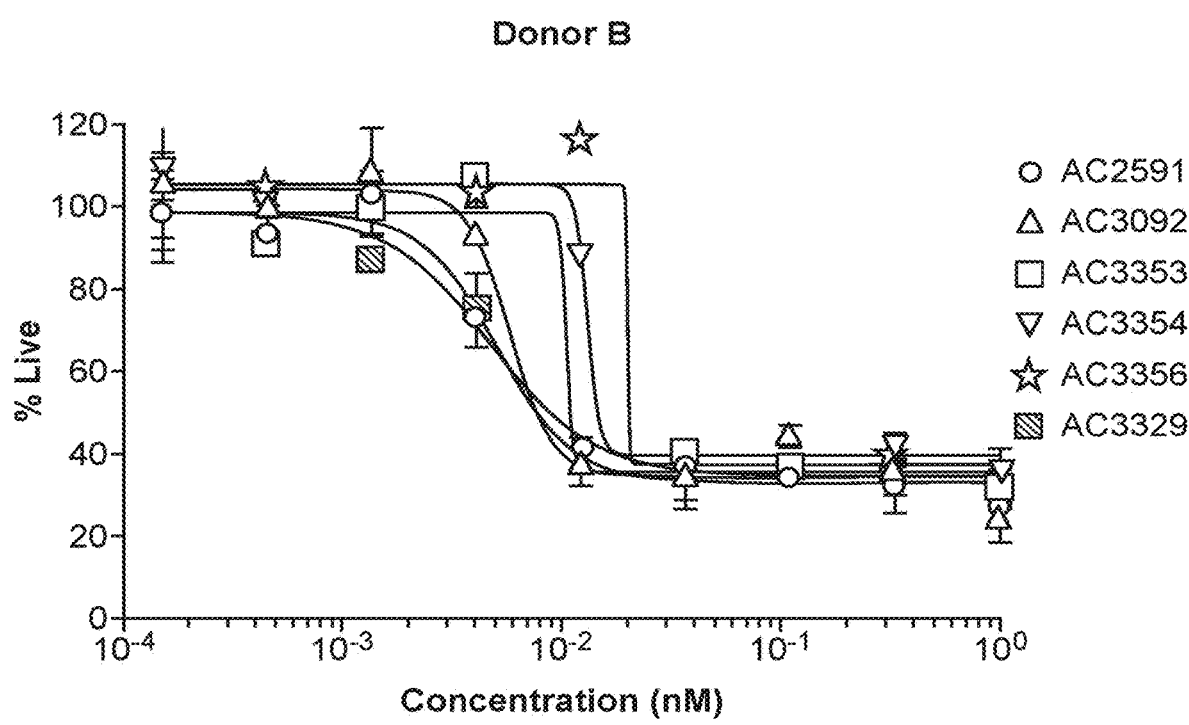
Figure 12C:
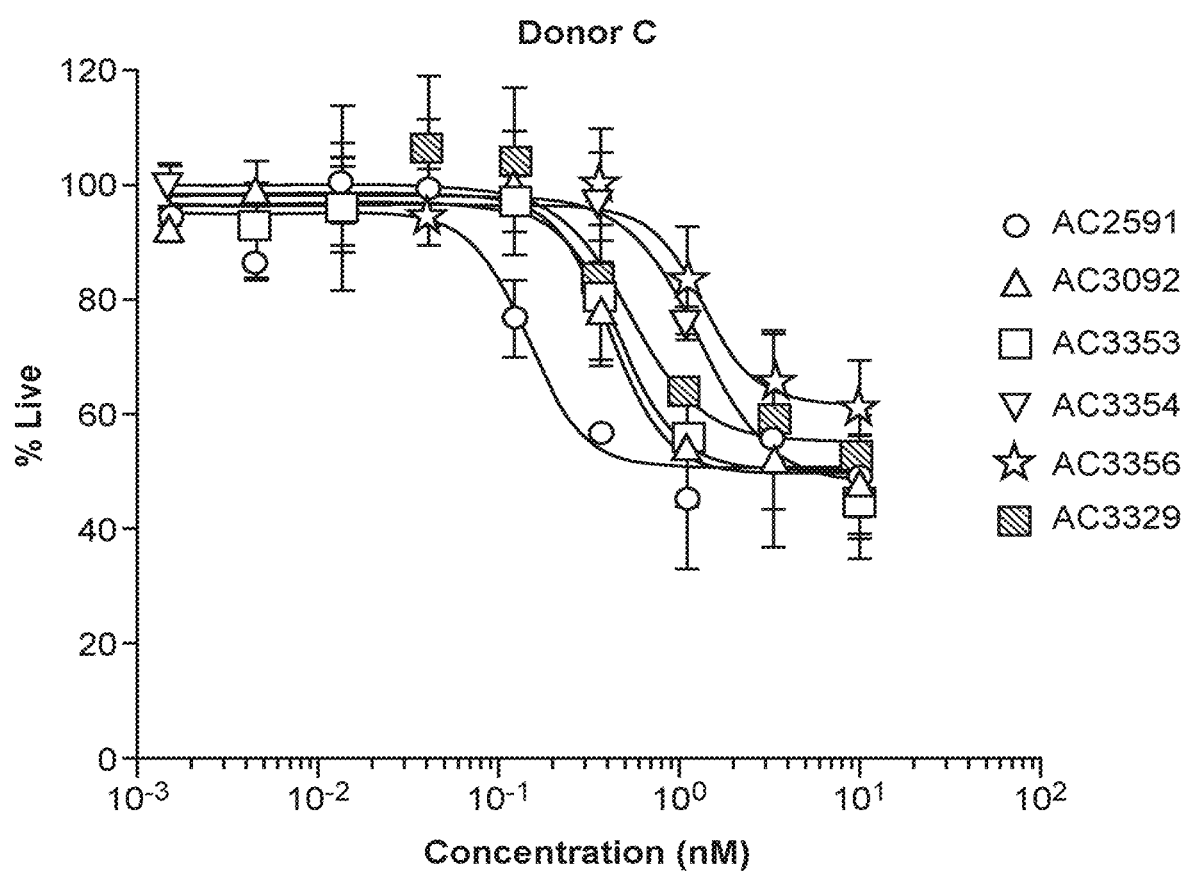

Variable amino acid linker lengths between the PSMA antibody and CD3 antibody were tested to determine their effect on in vitro cytotoxicity in the LNCaP and 22Rv1 cell lines. The results are shown below in Table 26. The dose response curves for Donors A-C are shown in FIG. 12A-FIG. 12C.

Figure 18:
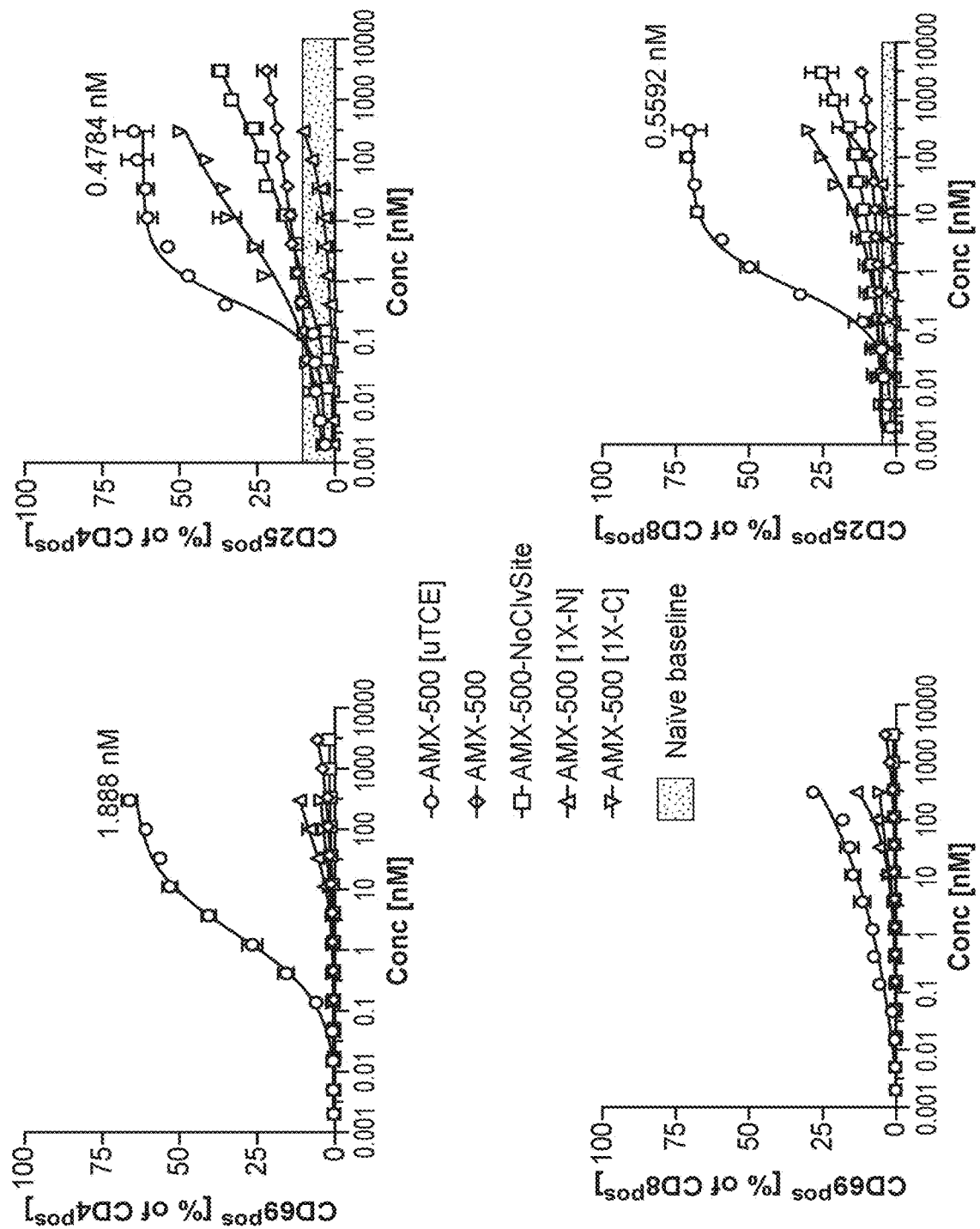
FIG. 18 depicts graphs of CD69, CD25, and PD-1 expression on CD4+ and CD8+ T cells from an LNCaP PSMA$^{high}$/PBMC co-culture that was incubated with various concentrations of AMX-500(uTCE), AMX-500, AMX-500(1x-N), AMX-500(1x-C), and AMX-500(NoClvSite). The cells were co-incubated with PBMCs at a ratio of 10:1 PBMCs to LNCap cells. PBMCs were taken from Donor 2.
Figure 18:
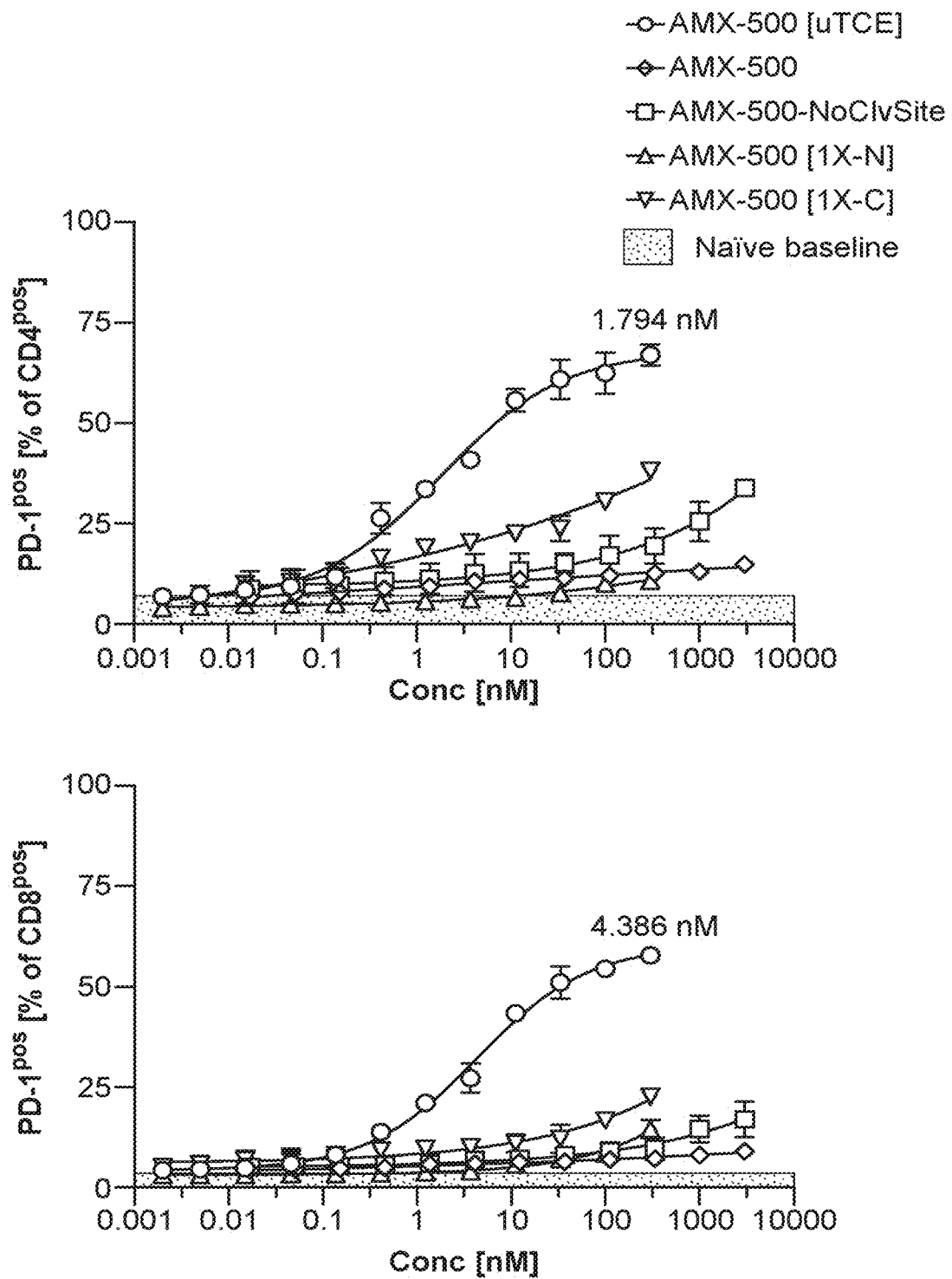
Figure 19:
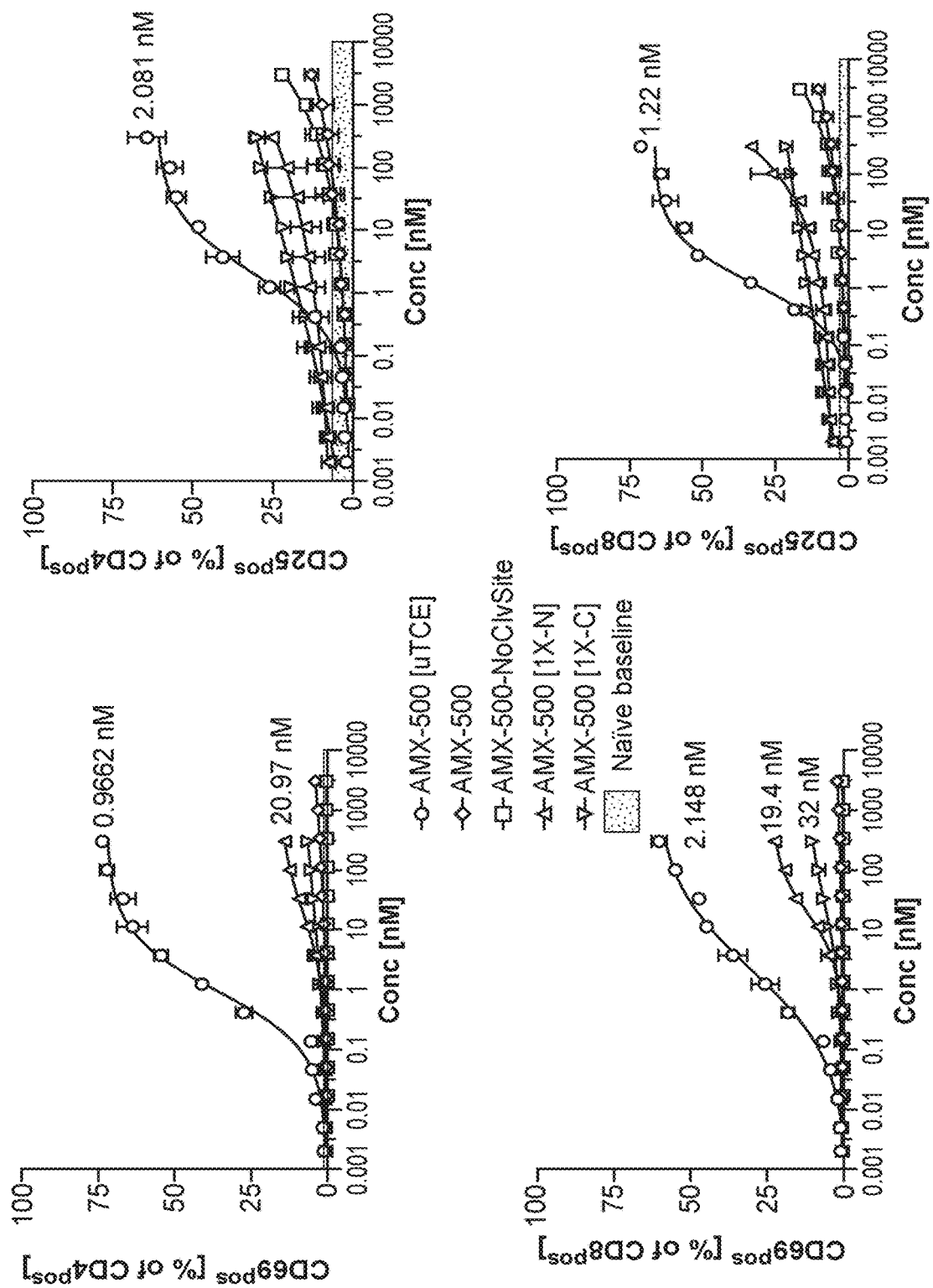
FIG. 19 depicts graphs of CD69, CD25, and PD-1 expression on CD4+ and CD8+ T cells from an LNCaP PSMA$^{high}$/PBMC co-culture that was incubated with various concentrations of AMX-500(uTCE), AMX-500, AMX-500(1x-N), AMX-500(1x-C), and AMX-500(NoClvSite). The cells were co-incubated with PBMCs at a ratio of 10:1 PBMCs to LNCap cells. PBMCs were taken from Donor 3.
Figure 19:
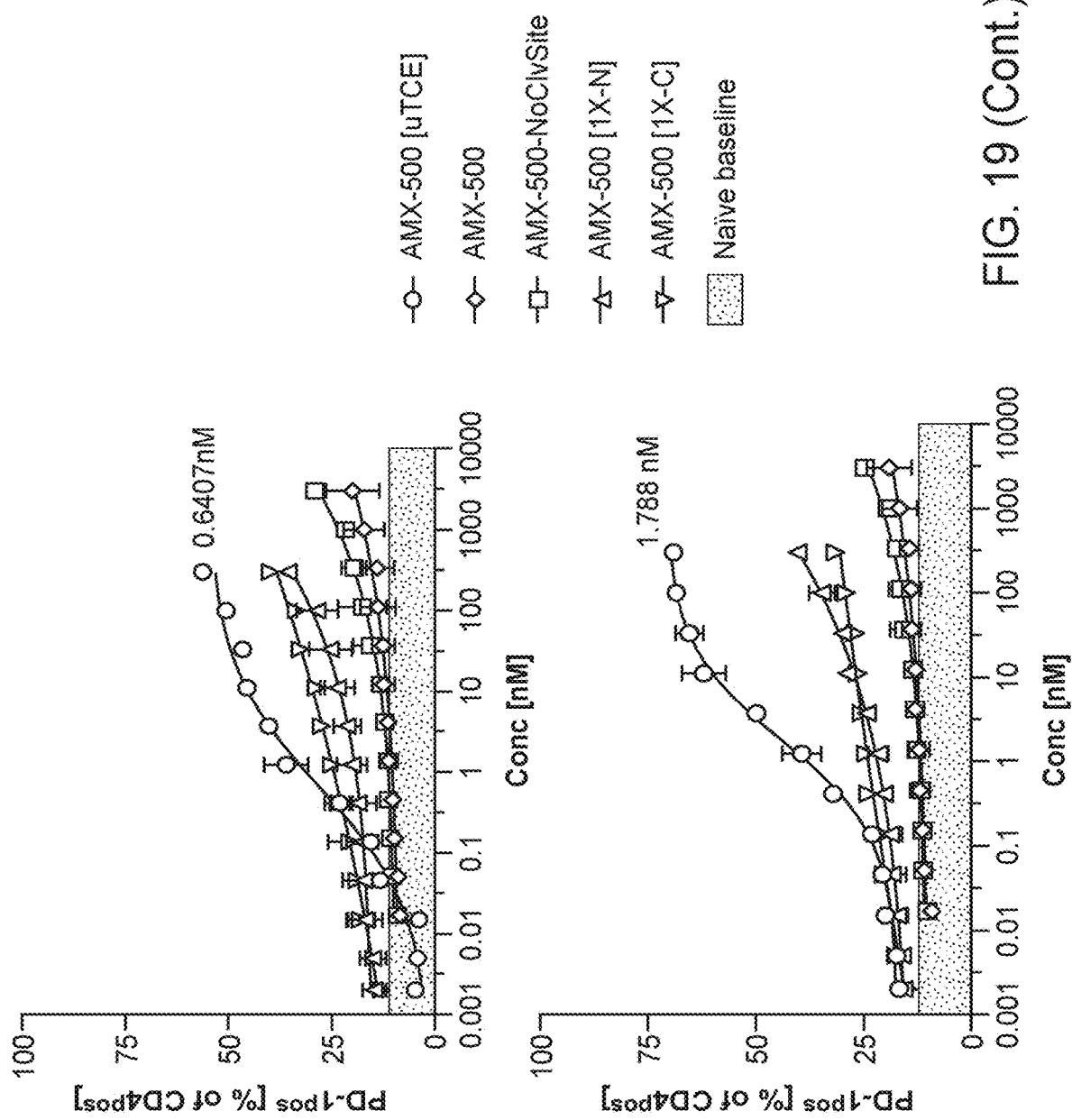

The T cell activity assay above was repeated across two additional donors (Donor 2 and Donor 3). Results for Donor 2 are shown in FIG. 18. Results for Donor 3 are shown in FIG. 19. The EC50 values (nM) are summarized below in Table 27.

TABLE 26 in vitro cytotoxicity assay IC50 values in the LnCaP cell line and 22Rv1 cell line with alternative linker lengths

| AC uTCE | Domains | Linker | CD3 Domain order | N_ELNN Length | C_ELNN Length | Description | IC50 (pM) LNCaP-FGC Donor A | IC50 (pM) LNCaP-FGC Donor B | IC50 (pM) 22Rv1 Donor C |
|---|---|---|---|---|---|---|---|---|---|
| uTCE of AC2591 | [PSMA.2]-[CD3.23] | 9 | VL-VH | 288 | 576 | Control, initial Camelid αPSMA | 5.1 | 5.2 | 146 |
| uTCE of AC3092 | [PSMA.5]-[CD3.23] | 9 | VL-VH | 144 | 144 | Control, initial humanized αPSMA | 5.9 | ND | 418 |
| uTCE of AC3353 | [PSMA.5]-[CD3.23] | 5 | VL-VH | 144 | 144 | 5mer GS VHH ScFv linker | ND | 15 | 470 |
| UTCE of AC3354 | [PSMA.5]-[CD3.23] | 15 | VL-VH | 144 | 144 | 15mer ELNN VHH ScFv linker | ND | 31 | 1,289 |
| uTCE of AC3356 | [PSMA.5]-[CD3.23] | 9 | VH-VL | 144 | 144 | cd3.23 VH-VL domain swap | 20.1 | 29 | 1,350 |
| uTCE of AC3329 | [PSMA.119]-[CD3.23] | 9 | VL-VH | 144 | 144 | L59K mutation from PSMA.5, PTE removal variant | 4.8 | ND | 532 |

The supernatants of LNCaP cells after cytotoxic reactions were harvested and in vitro cytokine assays were performed. In general, IL-6 and IL-10 induction by PSMA-paTCE lead AMX-500 was 100-1000 fold reduced compared to fully unmasked AMX-500(uTCE). Singly masked metabolite AMX-500(1x-N) and AMX-500(1x-C) induced IL-6 and IL-10 similar to fully masked AMX-500. AMX-500(uTCE) induced GM-CSF and IFN-g release at much lower levels than AMX-500. In general, the singly masked metabolites had intermediate response between uTCE and AMX-500. AMX-500 and the AMX-500-NoClvSite induced minimal GM-CSF and IFN-g. AMX-500 or AMX-500(uTCE) have minimal induction of IL-2 and IL-4. The maximum level of MCP-1 produced by AMX-500, and the various metabolites were the same ~9000 pg/ml.

Figure 16:
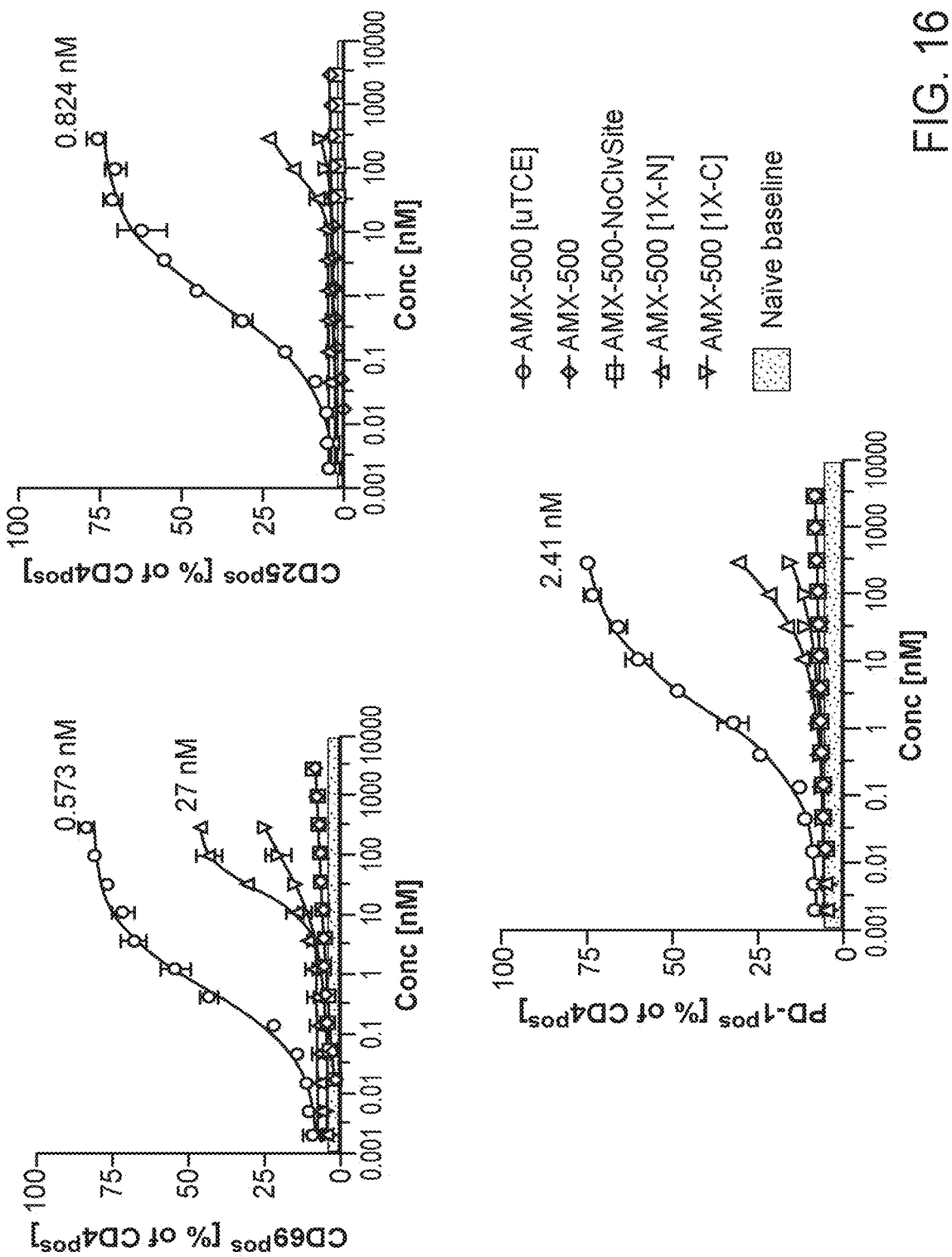
FIG. 16 depicts graphs of CD69, CD25, and PD-1 expression on CD4+ T cells from an LNCaP PSMA$^{high}$/PBMC co-culture that was incubated with various concentrations of AMX-500(uTCE), AMX-500, AMX-500(1x-N), AMX-500 (1x-C), and AMX-500(NoClvSite). The cells were co-incubated with PBMCs at a ratio of 10:1 PBMCs to LNCap cells. PBMCs were taken from Donor 1.
Figure 17:
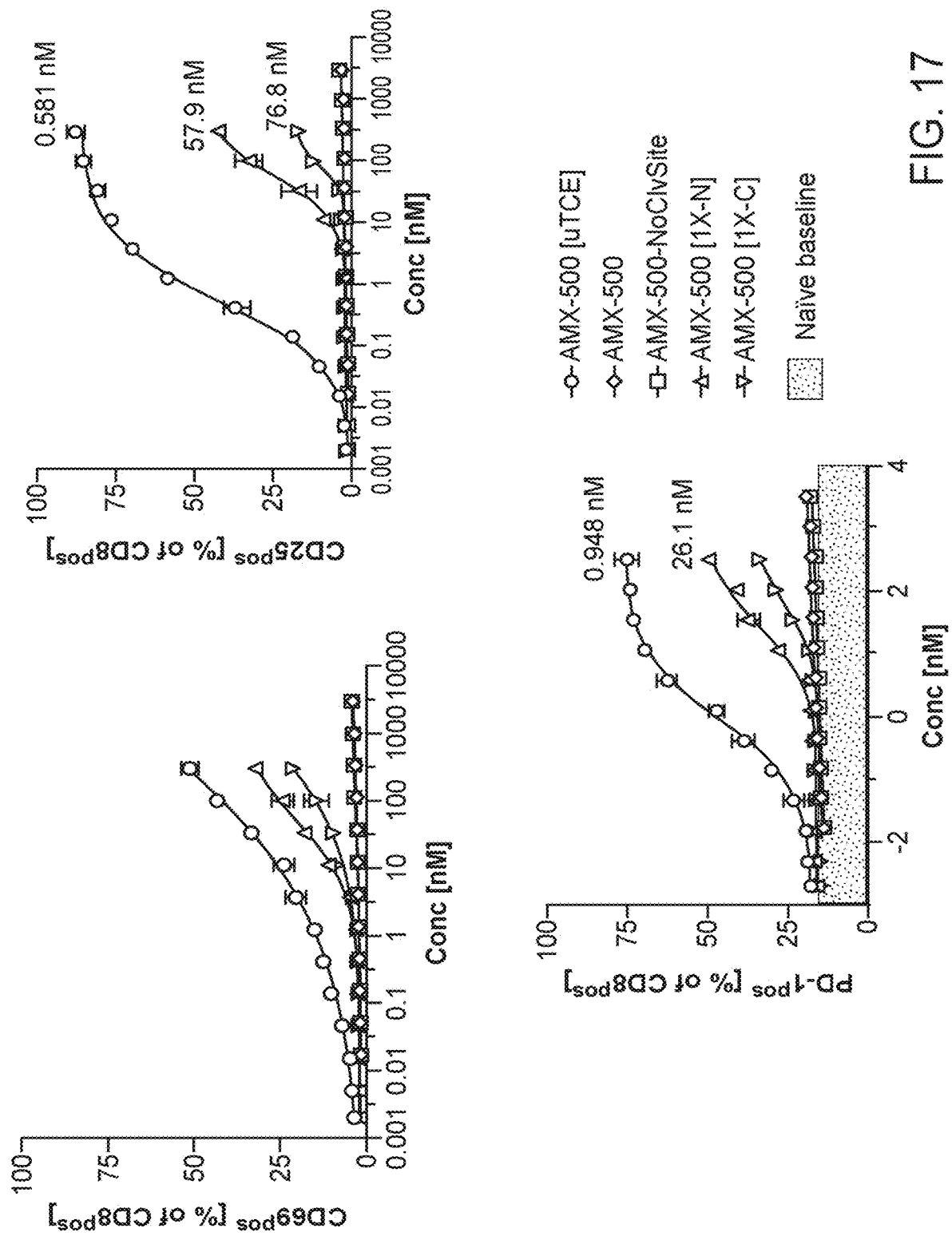
FIG. 17 depicts graphs of CD69, CD25, and PD-1 expression on CD8+ T cells from an LNCaP PSMA$^{high}$/PBMC co-culture that was incubated with various concentrations of AMX-500(uTCE), AMX-500, AMX-500(1x-N), AMX-500 (1x-C), and AMX-500(NoClvSite). The cells were co-incubated with PBMCs at a ratio of 10:1 PBMCs to LNCap cells. PBMCs were taken from Donor 1.

To evaluate the activity of T cells, AMX-500 or its metabolites were co-cultured with healthy human PBMCs together with LNCaP cells. Human PBMCs from Donor 1 were incubated with titrations of AMX-500 or metabolites in the presence of LNCaP cells at 37° C. (PMBC LNCaP cells at 10:1). After 72 hours, PBMCs were analyzed by flow cytometric analysis. Specifically, CD4 and CD8 T cells were interrogated for CD69, CD25, and PD-1 expression. Results are depicted in FIG. 16 and FIG. 17.

TABLE 27

EC50 values for T cell activation in CD4+ and CD8+ T cells based on CD69, CD25, and PD-1 expression

| CD4 T cells | AMX-500 [EC50, nM] | | | AMX-500 (uTCE) [EC50, nM] | | |
|---|---|---|---|---|---|---|
| Donor ID | CD69 | CD25 | PD-1 | CD69 | CD25 | PD-1 |
| Donor 1 | N.D. | N.D. | N.D. | 0.5726 | 0.8236 | 2.415 |
| Donor 2 | N.D. | N.D. | N.D. | 1.888 | 0.4784 | 1.794 |
| Donor 3 | N.D. | N.D. | N.D. | 0.9662 | 2.081 | 0.6407 |

| CD8 T cells | AMX-500 [EC50, nM] | | | AMX-500 (uTCE) [EC50, nM] | | |
|---|---|---|---|---|---|---|
| Donor ID | CD69 | CD25 | PD-1 | CD69 | CD25 | PD-1 |
| Donor 1 | N.D. | N.D. | N.D. | N.D. | 0.5807 | 0.9478 |
| Donor 2 | N.D. | N.D. | N.D. | N.D. | 0.5592 | 4.386 |
| Donor 3 | N.D. | N.D. | N.D. | 2.148 | 1.22 | 1.788 |

In summary, fully masked AMX-500 protected against T cell activation relative to AMX-500(uTCE). AMX-500 intermediates (1X-C, 1X-N) maintained protection relative to AMX-500(uTCE); albeit to a lesser extent (in general) than AMX-500.

TABLE 28

In vitro cytotoxicity in LNCaP PSMA$^{high}$ cells from 5 different donors. Values reported as IC50 (pM)

| Donor | AMX-500 (uTCE) | AMX-500 | AMX-500 (1X-N) | AMX-500 (1X-C) | AMX-500-NoClvSite |
|---|---|---|---|---|---|
| 1 | 24 | 42190 | 5377 | 8579 | 42005 |
| 2 | 15 | 44651 | 5709 | 6176 | 383235 |
| 3 | 16 | 37737 | 7893 | 6703 | 15188 |
| 4 | ND* | 38283 | 5359 | 12063 | 14893 |
| 5 | 32 | 85371 | 6439 | 6287 | 219590 |

*ND—not determined

Figure 13A:
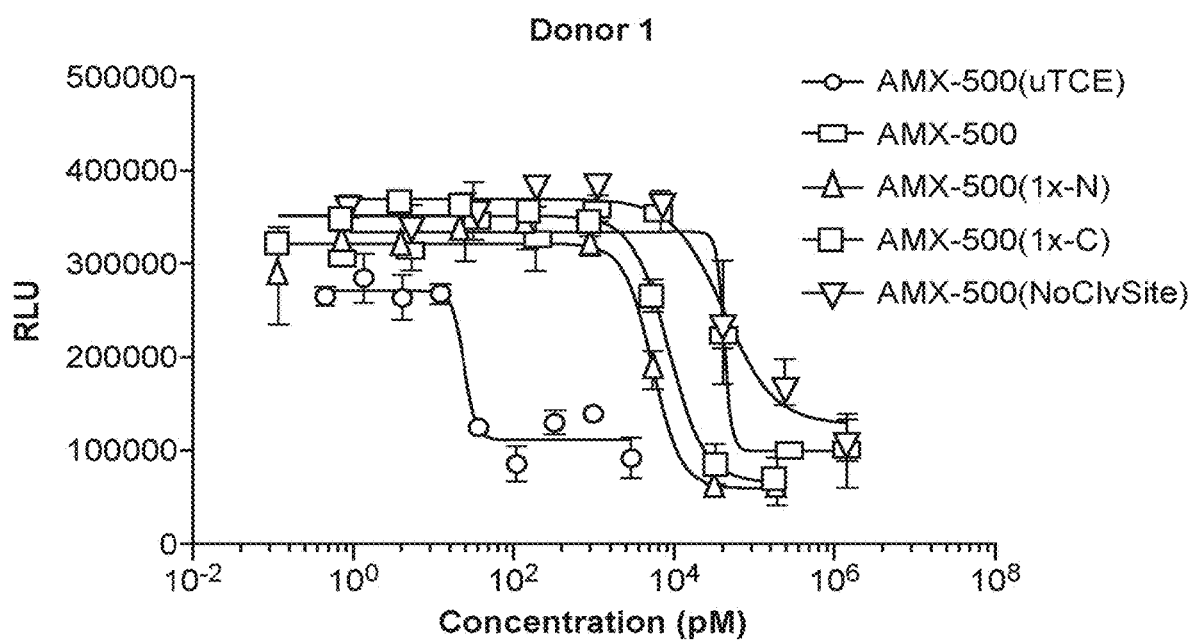
FIG. 13A and FIG. 13B depicts a graph of relative in vitro cytotoxicity of LNCaP PSMA$^{high}$ cells from donor 1 incubated with various concentrations of AMX-500(uTCE), AMX-500, AMX-500(1x-N), AMX-500(1x-C), and AMX-500(NoClvSite).
Figure 13B:
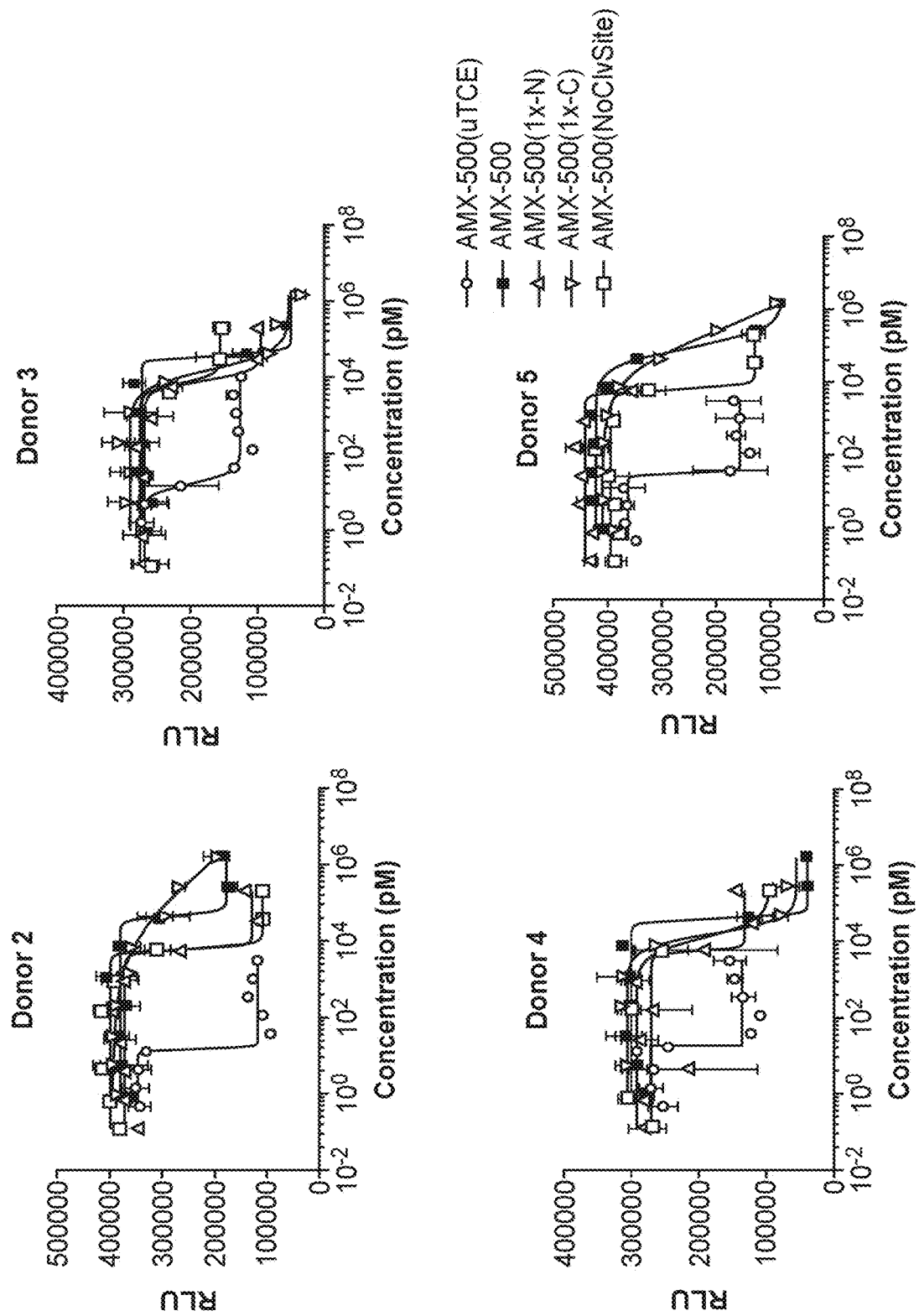

As shown above in Table 28 and FIG. 13A and FIG. 13B, AMX-500 provides ~2500-fold protection in the in vitro cytotoxicity assay compared to AMX-500(uTCE). Moreover, the AMX-500 cleavage intermediates (1x-N and 1x-C) maintain protection and reduce cytotoxicity by ~200-500-fold relative to AMX-500(uTCE). Finally, AMX-500(NoClvSite) exhibited cytotoxicity similar to AMX-500. AMX-500(NoClvSite) corresponds to a version of AMX-500 with masking polypeptides that are non-cleavable.

Figure 15:
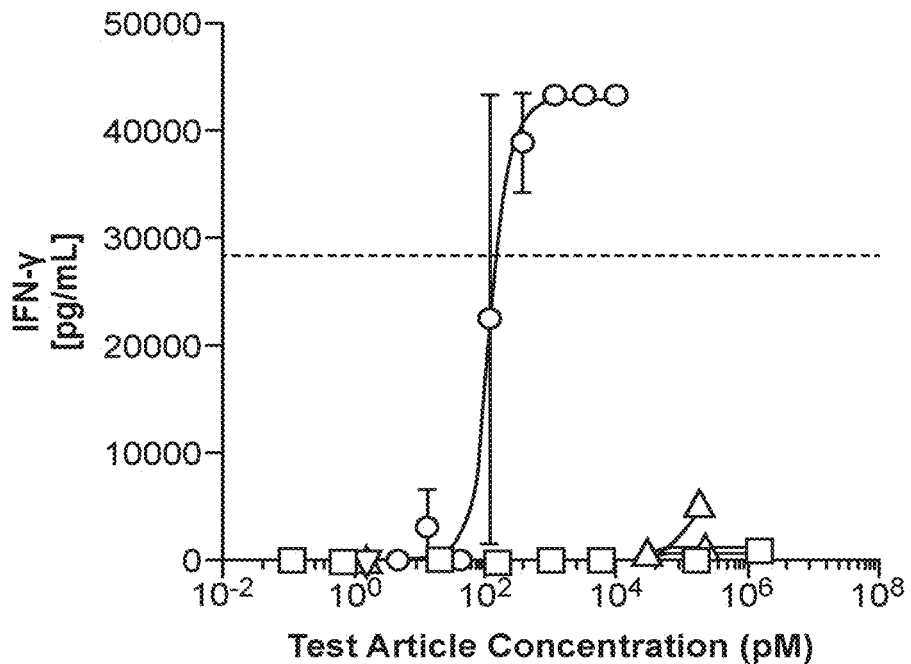
FIG. 15 depicts graphs of in vitro cytokine release from LNCaP PSMA$^{high}$ cells incubated with various concentrations of AMX-500(uTCE), AMX-500, AMX-500(1x-N), AMX-500(1x-C), and AMX-500(NoClvSite). The cells were co-incubated with PBMCs at a ratio of 10:1 PBMCs to LNCap cells. Levels of cytokines INF-γ, TNF-α, IL-6, IL-10, GM-CSF, IL-1β, IL-2, IL-4, and MCP-1 are shown.

An in vitro cytokine release assay was performed using PBMC: LNCAP cells at a 10:1 effector-target ratio. Cytokines INF-γ, TNF-α, IL-6, IL-10, GM-CSF, IL-1β, IL-2, IL-4, and MCP-1 were measured. The results are depicted in FIG. 15 for 1 of 5 donors (Donor 5). Similar results were obtained from samples from Donors 1-4.

In general, IL-6 and IL-10 induction by AMX-500 was 100-1000 fold reduced, relative to AMX-500(uTCE), and the singly masked metabolites induced IL-6 and IL-10 similar to AMX-500.

AMX-500(uTCE) induced GM-CSF and IFN-γ release at much higher levels compared to AMX-500, and the singly masked metabolites had intermediate response between uTCE and AMX-500. AMX-500 and the AMX-500-NoClvSite induced minimal GM-CSF and IFN-γ.

AMX-500(uTCE) induced TNF-α and IL-1β response at a much higher level compared to AMX-500. The singly masked metabolites induced TNF-α and IL-1β levels similar to AMX-500. AMX-500 and AMX-500-NoClvSite produced minimal to not measurable levels of TNF-α and IL-1β.

There was minimal induction of IL-2 and IL-4 observed with AMX-500 or AMX-500(uTCE).

The maximum level of MCP-1 produced by AMX-500, and the various formats was same at ~9000 pg/ml.

TABLE 29

In vitro cytotoxicity in 22Rv1 PSMA$^{high}$ cells from 3 different donors. Values reported as IC50 (pM)

| Donor ID | AMX-500 (uTCE) | AMX-500 | AMX-500 (NoClvSite) | AMX-500 (1X-N) | AMX-500 (1X-C) |
|---|---|---|---|---|---|
| 1 | 691 | ND | ND | ND | ND |
| 2 | 1343 | ND | ND | ND | ND |
| 3 | 1298 | ND | ND | ND | ND |

* ND—not determined

Figure 14A:
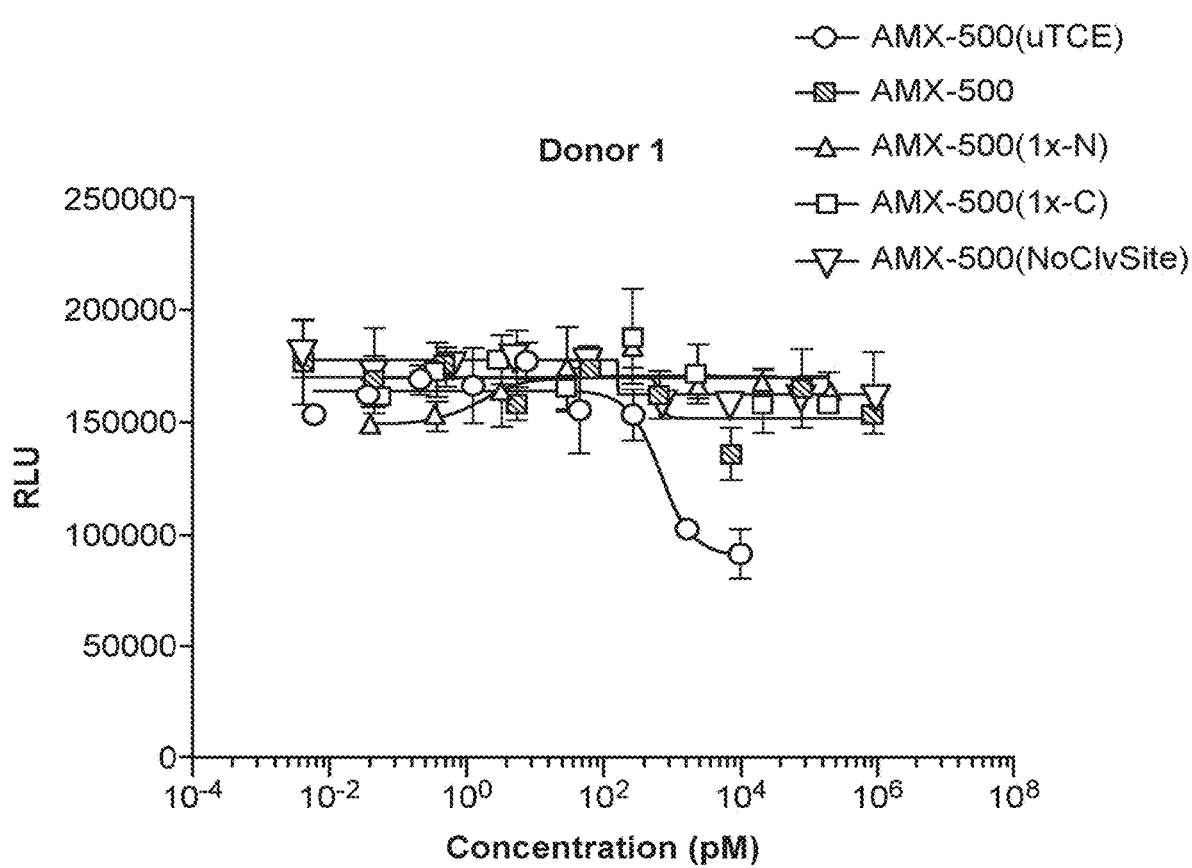
FIG. 14A and FIG. 14B depicts a graph of relative in vitro cytotoxicity of 22Rv1 PSMA$^{low}$ cells from donor 1 incubated with various concentrations of AMX-500(uTCE), AMX-500, AMX-500(1x-N), AMX-500(1x-C), and AMX-500(NoClvSite).
Figure 14B:
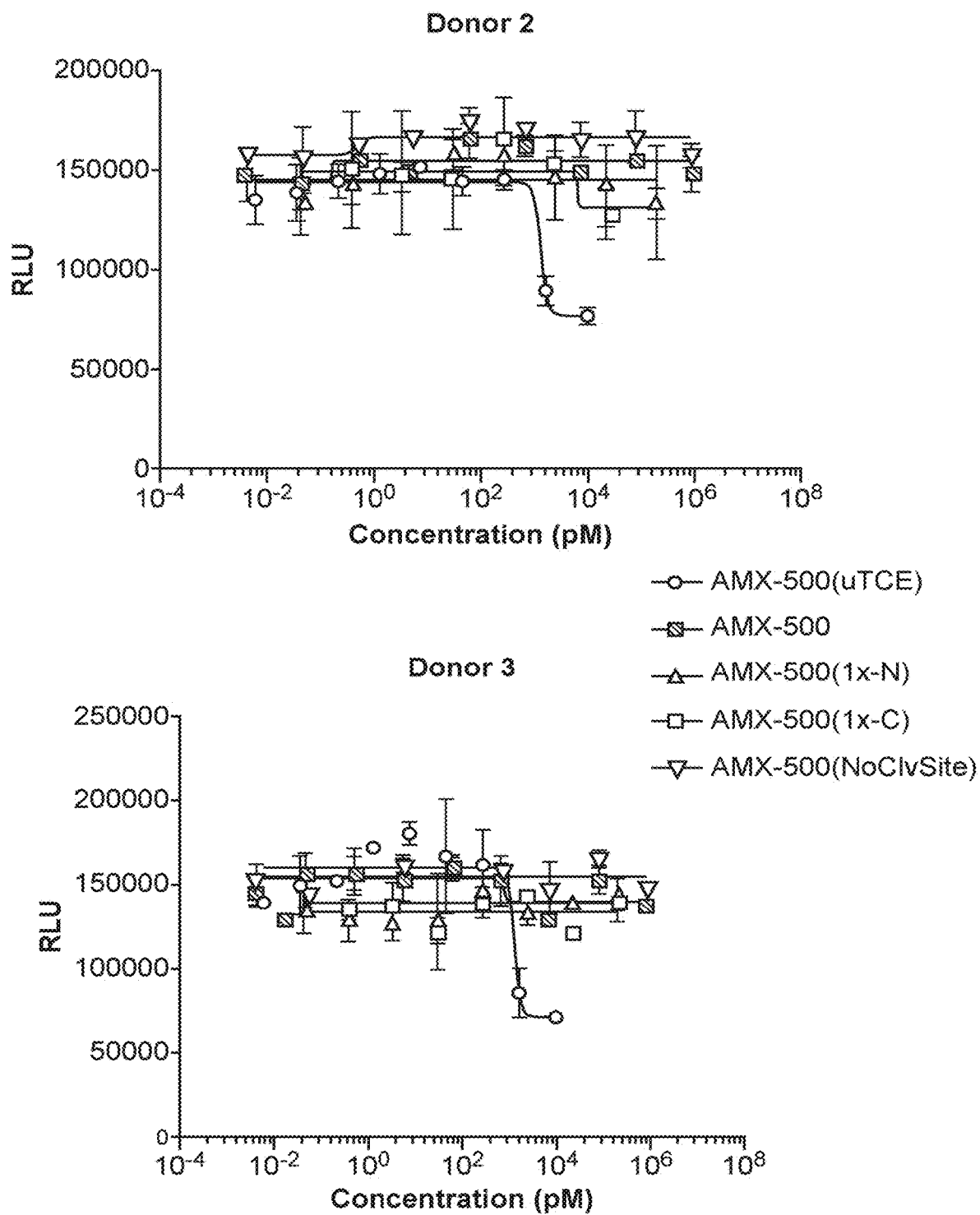

As shown above in Table 29 and FIG. 14A and FIG. 14B, AMX-500(uTCE) has reduced cytotoxicity against the 22Rv1 cells, which have a receptor density of about 4,000 copies of PSMA per cell, compared to the LNCaP cells, which have a receptor density of about 209,000 copies of PSMA per cell.

Off-Target Binding Assay

Figure 20A:
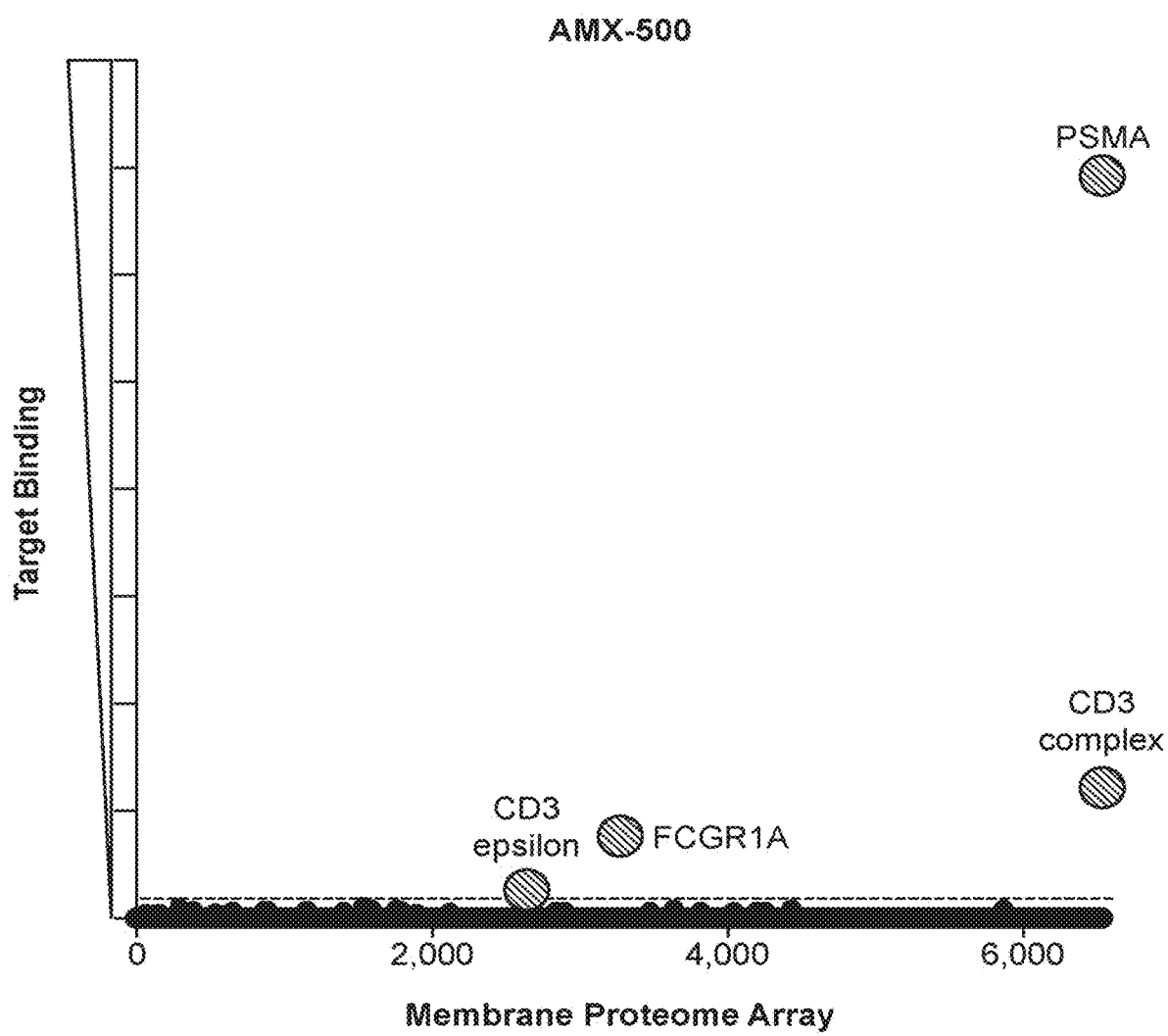
FIG. 20A and FIG. 20B depict relative target binding of AMX-500 (FIG. 20A) and AMX-500-P7 (AC3934, FIG. 20B) to about 6,000 different HEK293T membrane proteins.
Figure 20B:
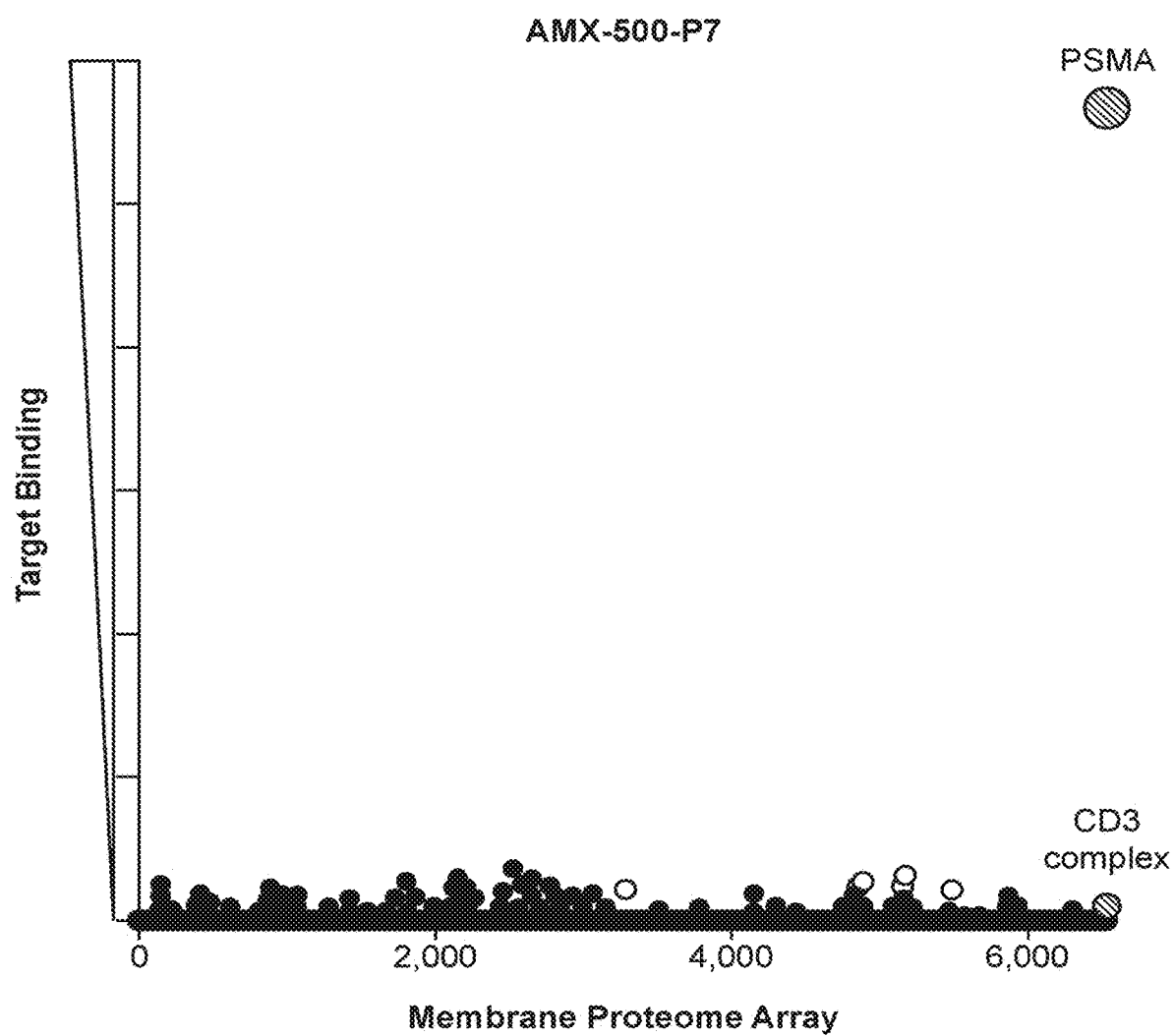

Off-target binding of AMX-500 was measured against about 6,000 different membrane proteins in HEK293T cells. Ligand binding detection was done via immunofluorescence FACS. Validation of hits with signal >3 standard deviations above background was considered. As shown in FIG. 20A and FIG. 20B, AMX-500 and AMX-500-P7 do not bind to any of the 6,000 targets above background other than PSMA, CD3 complex, and CD3 epsilon. Binding to FCGR1A was determined to be an artifact of the secondary antibody binding.

In Vivo Efficacy in Mice

Figure 21:
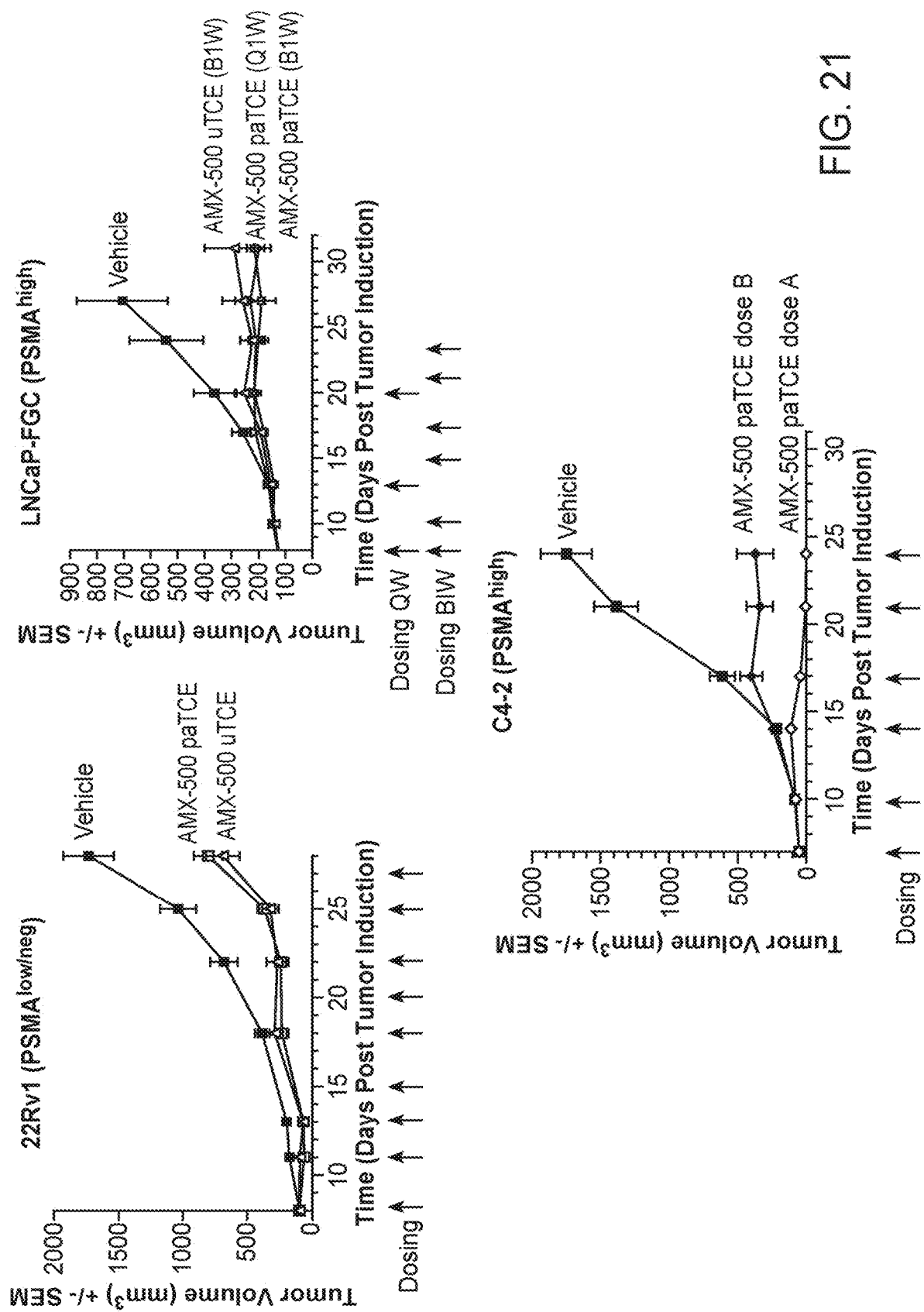
FIG. 21 depicts graphs of tumor volume from human prostate tumor mouse models. Tumor mouse models were generated with 22Rv1 PSMA$^{low}$ cells, LNCaP PSMA$^{high}$ cells, or C4-2 PSMA$^{high}$ cells. For the 22Rv1 model, AMX-500 paTCE was dosed at 2 mg/kg, 16 nmol/kg and AMX-500 unmasked TCE (uTCE) was dosed at 0.35 mg/kg, 7.6 nmol/kg. For the LNCaP model, AMX-500 paTCE was dosed at 3 mg/kg, 24 nmol/kg and AMX-500 uTCE was dosed at 0.35 mg/kg, 7.6 nmol/kg. For the C4-2 model, dose A was 7.5 mg/kg, 59 nmol/kg, BIW and dose B was 3.5 mg/kg, 27 nmol/kg, BIW.

PSMA-paTCE AMX-500 was evaluated in three in vivo cell line-derived xenograft (CDX) models which includes C4-2 (PSMA$^{high}$, androgen-independent), LNCaP-FGC (PSMA$^{high}$) and 22Rv1 (PSMA$^{low/neg}$) cell lines. AMX-500 exhibits tumor growth inhibition in 3.5 mg/kg and 7.5 mg/kg twice weekly via IV injection in C4-2 model. AMX-500 exhibits tumor growth inhibition in 3 mg/kg twice or once weekly via IV injection in LNCaP model. AMX-500(uTCE) exhibits tumor growth inhibition in 0.35 mg/kg twice weekly via IV injection in LNCaP model. AMX-500 exhibits tumor growth inhibition in 2 mg/kg twice weekly via IV injection in 22Rv1 model. AMX-500(uTCE) exhibits tumor growth inhibition in 0.35 mg/kg twice weekly via IV injection in 22Rv1 model (FIG. 21).

Additional in vivo efficacy experiments were performed at a range of alternative doses.

The in vivo efficacy of AMX-500, AMX-500-NoClvSite, and AMX-500(uTCE) was evaluated in the human PBMC-engrafted LNCaP-fast-growing colony (FGC) human prostate tumor model in nonobese diabetic (NOD).Cg-Prkdc$^{scid}$ Il2rg$^{tm1Wjl}$/SzJ (NSG) mice.

Figure 22:
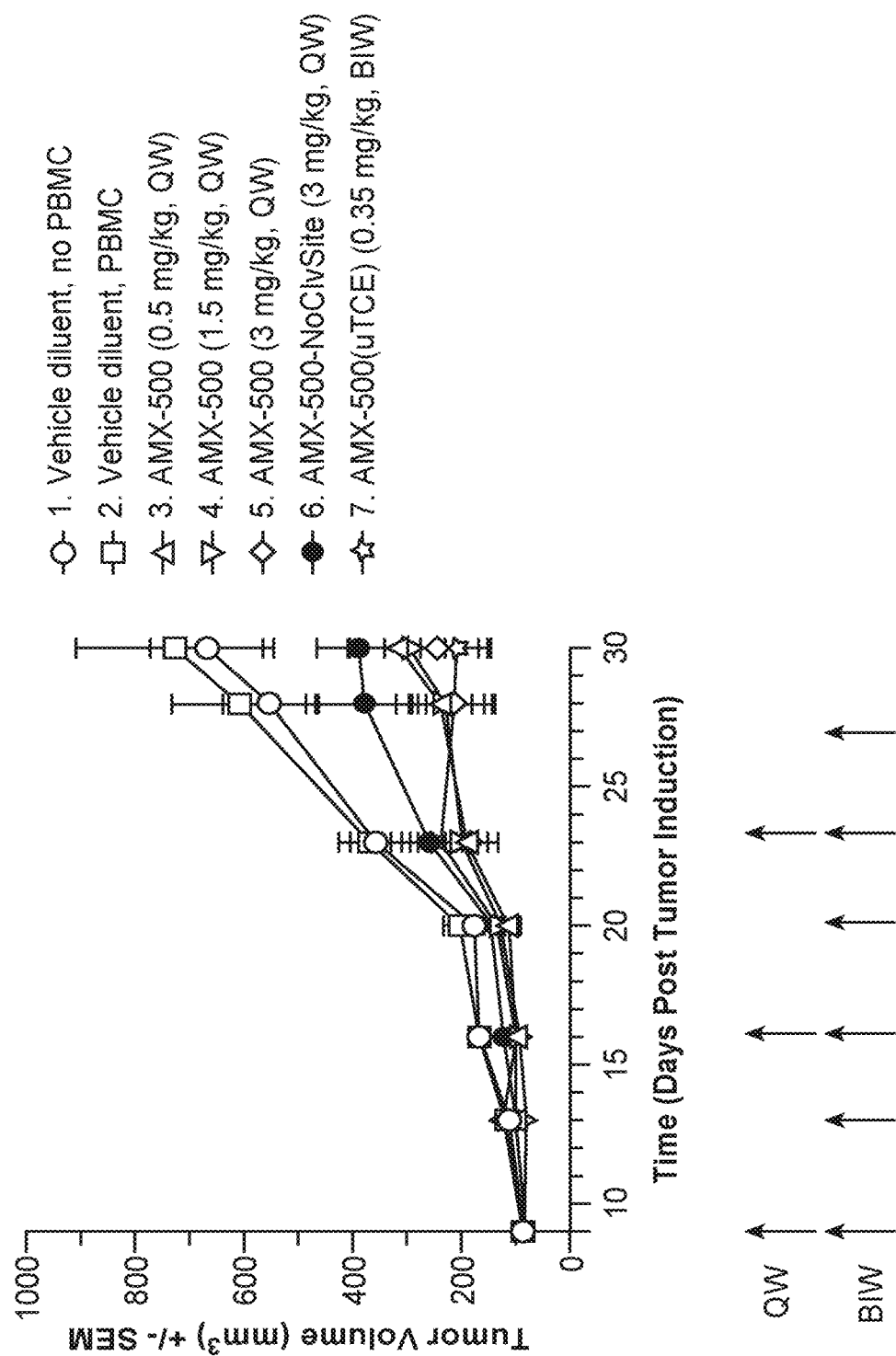
FIG. 22 depicts graphs of tumor volume from human prostate tumor mouse models of LNCaP PSMA$^{high}$ cells.

Mice bearing LNCaP-FGC tumors were randomized into 7 groups of 8 mice each and administered vehicle diluent (no PBMC), vehicle diluent (PBMC), 0.5 mg/kg AMX-500, 1.5 mg/kg AMX-500, 3 mg/kg AMX-500, and 3 mg/kg AMX-500-NoClvSite by weekly bolus IV, and 3 mg/kg AMX-500 (uTCE) by twice-weekly bolus IV. The AMX-500(uTCE) was administered twice-weekly to account for the expected more rapid elimination of the unmasked TCE. Experimental design and results summary are shown in Table 30. Tumor growth curves between treatment initiation (Day 8) and study termination (Day 28) are shown in FIG. 22.

All test articles were well tolerated by the experimental animals, as evidenced by the similar average body weight loss (BWL) in the range of 3-9% across all experimental groups.

AMX-500 treatment promoted anti-tumor activity at all dose levels evaluated when compared with the applicable PBMC-engrafted control, Group 2. At Day 30, the end of the study, AMX-500 at a dose level of 3 mg/kg QW showed TGI of 75% (p<0.0001), while the intermediate (1.5 mg/kg QW) and lowest (0.5 mg/kg QW) dose levels showed TGIs of 62% (p=0.0129) and 64% (p=0.0149), respectively. At Day 30, AMX-500 treatment at the highest tested dose of 3 mg/kg QW had similar TGI (75% TGI) as the enzymatically cleaved and activated AMX-500(uTCE) (80% TGI) using a 0.35 mg/kg twice weekly (BIW) dose. As the masks on AMX-500 only reduce binding and activity, AMX-500-NoClvSite did exhibit a partial response in this model (52% TGI). However, the protease-activatable AMX-500 exhibited a greater anti-tumor effect at a dose of 0.5 mg/kg (64% TGI) than that observed with AMX-500-NoClvSite at a QW dose of 3 mg/kg (52% TGI), indicating that the ELNN masks of AMX-500 may be removed in the tumor micro-environment, releasing the potent unmasked TCE.

TABLE 30

Study Design and Results Summary

| | | | Study Design | | | | Day 30 Results | | |
|---|---|---|---|---|---|---|---|---|---|
| Group | N | Treatment | Dose Level (mg/kg) | Dosing Volume (mL/kg) | Route | Dosing Frequency and Duration | BWL | TGI | Tumor Regression [b] (#/n) |
| 1 | 8 | Vehicle diluent, no PBMC | — | 10 | IV | QW × 3 weeks | 7.5% | — | 0/8 |
| 2 | 8 | Vehicle diluent, PBMC | — | 10 | IV | QW × 3 weeks | 8.4% | — | 0/8 |
| 3 | 8 | AMX-500 | 0.5 | 10 | IV | QW × 3 weeks | 6.5% | 64% | 2/8 |
| 4 | 8 | AMX-500 | 1.5 | 10 | IV | QW × 3 weeks | 7.2% | 62% | 2/7 |
| 5 | 8 | AMX-500 | 3.0 | 10 | IV | QW × 3 weeks | 3.7% | 75% | 4/8 |
| 6 | 8 | AMX-500-NoClv Site | 3.0 | 10 | IV | QW × 3 weeks | 8.6% | 52% | 2/8 |
| 7 | 8 | AMX-500(uTCE) | 0.35 | 10 | IV | BIW × 3 weeks | 8.2% | 80% | 1/8 |

Abbreviations: BIW, 2 times a week; BWL, body weight loss compared with body weight at the start of treatment; IV, intravenous; NA, not applicable; PBMC, peripheral blood mononuclear cells; QW, one time a week; TGI, tumor growth inhibition.
[a] TGI (%) = (Vc − Vt)/(Vc − Vo) × 100, where Vc and Vt are the mean tumor volume of the control and treated groups at the end of the study (respectively) and Vo is the mean tumor volume of the control group at the start of dosing. TGI was calculated versus Group 2 (Vehicle diluent, PBMC).
[b] Tumor regression was defined as tumor volume at study end (Day 30), which is less than the starting tumor volume prior to dosing.

The in vivo efficacy of AMX-500(uTCE) and AMX-500 was evaluated in the human ex vivo-activated pan T cells-engrafted 22Rv1 human prostate tumor model in NSG mice.

Figure 23:
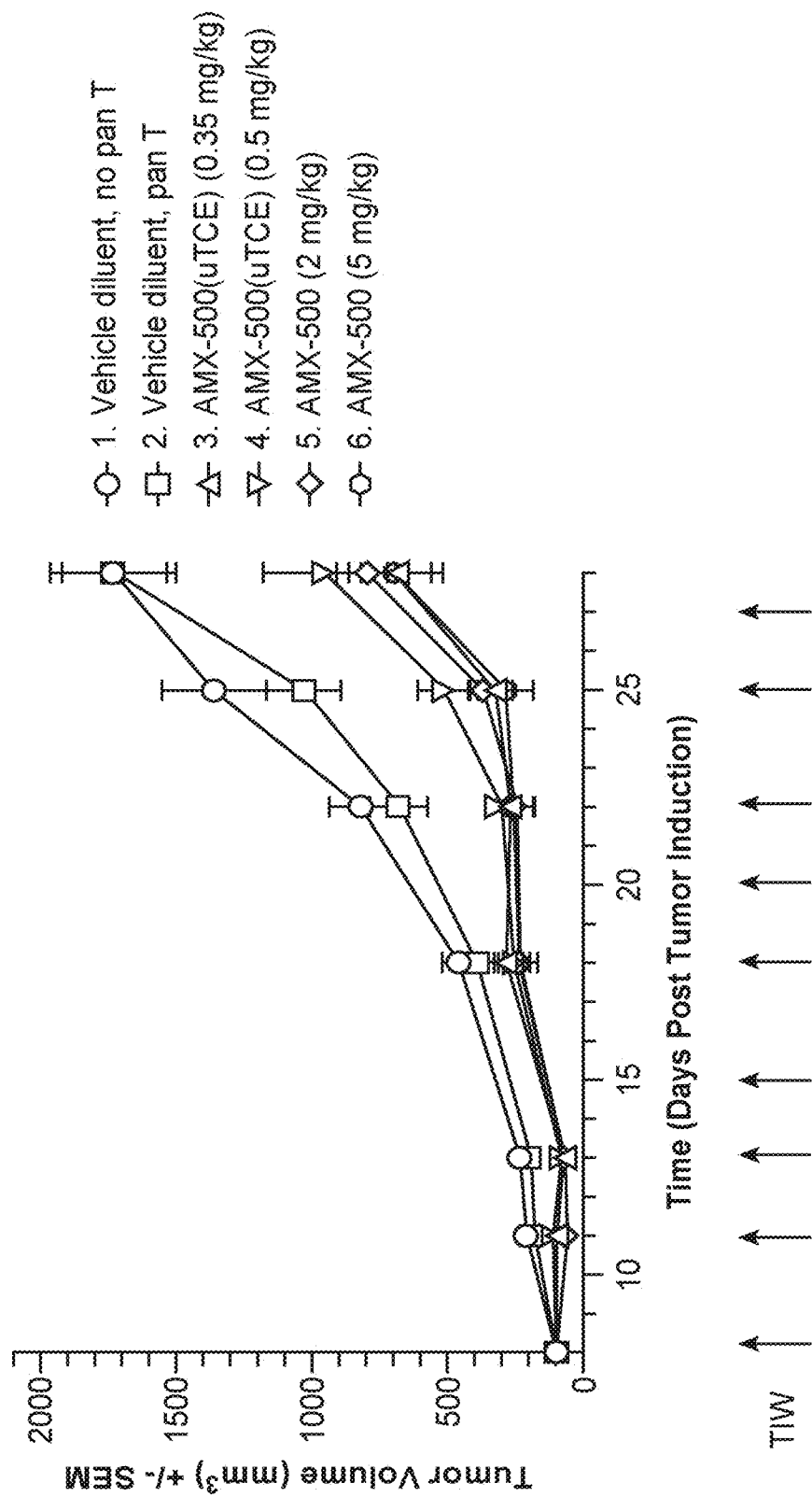
FIG. 23 depicts graphs of tumor volume from human prostate tumor mouse models of 22Rv1 PSMA$^{low}$ cells.

Mice bearing 22Rv1 tumors were randomized into 1 group of 10 and 5 groups of 9 mice each and administered either vehicle diluent (no pan T), vehicle diluent (with pan T), 0.35 mg/kg AMX-500(uTCE), 0.5 mg/kg AMX-500 (uTCE), 2 mg/kg AMX-500, or 5 mg/kg AMX-500 3 times a week for 3 weeks via bolus IV lateral tail vein injection. Experimental design and results summary are shown in Table 31. Tumor growth curves between treatment initiation (Day 8) and study termination (Day 28) are shown in FIG. 23.

All test articles were generally well tolerated by test animals, as shown by the minimal average BWL in the range of 0.6 to 5.6% across groups on Day 28.

AMX-500(uTCE) and AMX-500 promoted antitumor activity at all dose levels evaluated when compared with the applicable pan T-engrafted control, Group 2. At Day 28, the treatment groups had TGI in the range of 47.4 to 63.7%, indicating that AMX-500 has activity in this PSMA-low expressing mouse tumor model.

TABLE 31

Study Design and Results Summary

| | | | Study Design | | | | Day 28 Results | |
|---|---|---|---|---|---|---|---|---|
| Group | N | Treatment | Dose Level (mg/kg) | Dosing Volume (mL/kg) | Route | Dosing Frequency and Duration | BWL | TGI |
| 1 | 10 | Vehicle (no pan T) | NA | 10 | IV | TIW × 3 weeks | 1.6% | — |
| 2 | 9 | Vehicle + pan T | NA | 10 | IV | TIW × 3 weeks | 1.9% | — |
| 3 | 9 | AMX-500(uTCE) | 0.35 | 10 | IV | TIW × 3 weeks | 2.0% | 63.7% |
| 4 | 9 | AMX-500(uTCE) | 0.5 | 10 | IV | TIW × 3 weeks | 5.6% | 47.4% |
| 5 | 9 | AMX-500 | 2 | 10 | IV | TIW × 3 weeks | 4.1% | 56.7% |
| 6 | 9 | AMX-500 | 5 | 10 | IV | TIW × 3 weeks | 0.6% | 63.6% |

Abbreviations: BWL = body weight loss compared with body weight at the start of treatment; IV = intravenous; TGI = tumor growth inhibition; TIW = 3 times a week.
[a] TGI (%) = (Vc − Vt)/(Vc − Vo) × 100, where Vc and Vt are the mean tumor volume of the control and treated groups at the end of the study (respectively) and Vo is the mean tumor volume of the control group at the start of dosing. TGI was calculated versus Group 2 (vehicle diluent + pan T).

In Vivo Efficacy in Mice—Pembrolizumab Combination

Figure 24:
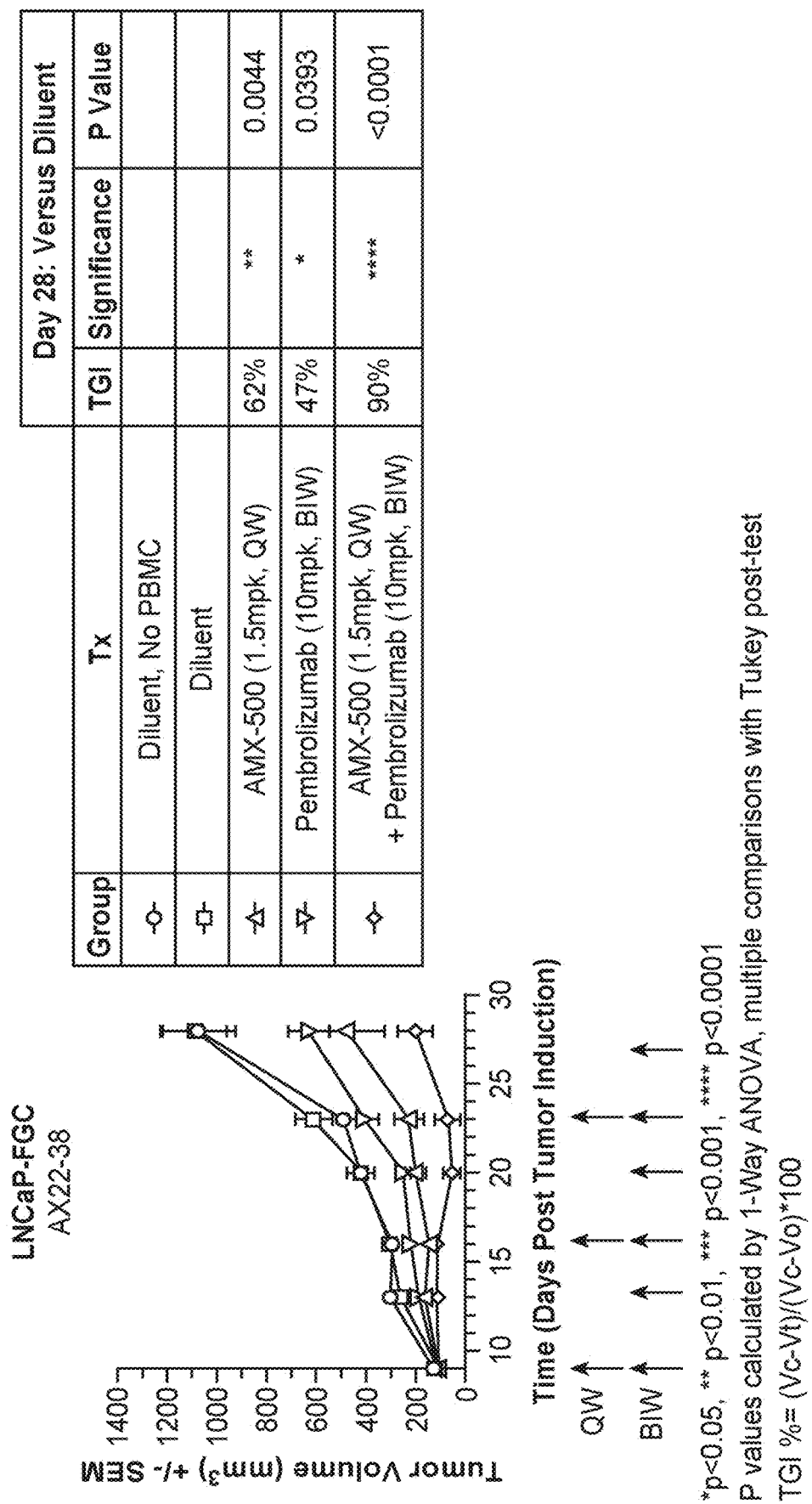
FIG. 24 depicts a graph of tumor volume from a human prostate tumor mouse model administered AMX-500, the anti-PD-1 antibody pembrolizumab, or the combination of AMX-500 and pembrolizumab.
Figure 25:
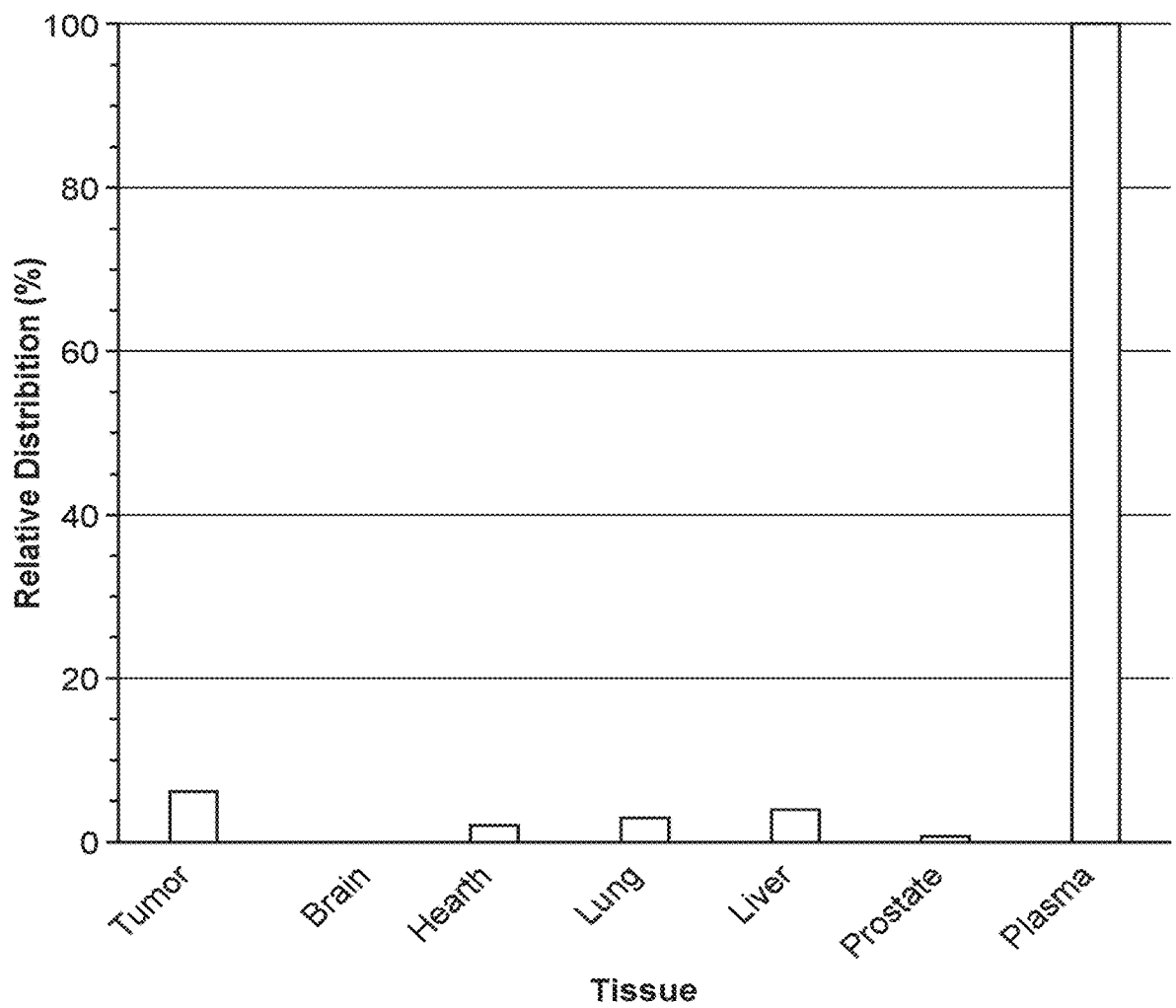
FIG. 25 depicts tissue distribution of AMX-500 in a mouse tumor model.

In addition, a combination of AMX-500 and pembrolizumab was tested in LNCaP CDX model. A treatment of 1.5 mg/kg of AMX-500 (once weekly IV injection) together with 10 mg/kg of pembrolizumab (twice weekly IV injection) exhibits enhanced anti-tumor activity up to 90% tumor growth inhibition (TGI) (FIG. 24).

In Vivo Toxicity Assessment

AMX-500 was administrated to cynomolgus monkeys. Cynomolgus monkeys were followed by 4-week recovery schedule to evaluate reversibility of any findings. In general, AMX-500 is well tolerated with no apparent treatment related findings observed, including no apparent treatment related clinical signs, no apparent treatment related change in clinical pathology, no apparent treatment related findings in ophthalmology exams and no apparent treatment related findings in gross necropsy.

In Vivo Tumor Distribution and Tumor Cleavage

The tumor tissue distribution and masking polypeptide cleavage of AMX-500 was determined. Tumor-bearing mice were administered fluorescently labeled AMX-500. Multiple xenograft tumor models (LNCAP-FGC, 22RV1) were evaluated and select tissues and plasma was collected 48 hours post-administration. A control paTCE was spiked in during homogenization of tissues. Relative abundance of AMX-500 and cleavage products were quantified by SDS-PAGE and LI-COR detection. As shown in FIG. 26, AMX-500 distributed to healthy tissue and xenografted tumor within 48 hours after administration. As shown in Table 32, AMX-500 cleavage intermediates and fully unmasked AMX-500 were detected in the LNCaP-FGC xenograft. Minimal cleavage of AMX-500 observed in plasma or healthy tissue. AMX-500 cleavage not observed in 22Rv1 xenograft model, nor additional PDx models (n=4).

TABLE 32

| In vivo cleavage relative abundance | | | | |
|---|---|---|---|---|
| — | AMX-500 | 1X-N | 1X-C | uTCE |
| Tumor | 86.5% | 1.4% | 3.1% | 8.9% |
| Brain | 100% | ND | ND | ND |
| Heart | 100% | ND | ND | ND |
| Lung | 99.4% | ND | <2% | ND |
| Liver | 98.5% | <2% | <2% | ND |

TABLE 32-continued

| In vivo cleavage relative abundance | | | | |
|---|---|---|---|---|
| — | AMX-500 | 1X-N | 1X-C | uTCE |
| Prostate | 100% | ND | ND | ND |
| Plasma | 98.3% | 0.6% | 1.1% | <0.1% |

While embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (9454 sequences)

SEQ ID NO: 1 - protein, 14 aa, synthetic construct
RSSNGAVTSSNYAN

SEQ ID NO: 2 - protein, 14 aa, synthetic construct
RSSNGEVTTSNYAN

SEQ ID NO: 3 - protein, 14 aa, synthetic construct
RSSTGAVTTSNYAN

SEQ ID NO: 4 - protein, 7 aa, synthetic construct
GTNKRAP

SEQ ID NO: 5 - protein, 7 aa, synthetic construct
GTIKRAP

SEQ ID NO: 6 - protein, 9 aa, synthetic construct
ALWYPNLWV

SEQ ID NO: 7 - protein, 9 aa, synthetic construct
ALWYSNLWV

SEQ ID NO: 8 - protein, 10 aa, synthetic construct
GFTFNTYAMN

SEQ ID NO: 9 - protein, 19 aa, synthetic construct
RIRSKYNNYATYYADSVKD

SEQ ID NO: 10 - protein, 14 aa, synthetic construct
HENFGNSYVSWFAH

SEQ ID NO: 11 - protein, 14 aa, synthetic construct
HGNFGNSYVSWFAY

SEQ ID NO: 12 - protein, 10 aa, synthetic construct
GFTFSTYAMN

SEQ ID NO: 13 - protein, 19 aa, synthetic construct
RIRTKRNNYATYYADSVKG

SEQ ID NO: 14-47 - skipped (34 entries)

SEQ ID NO: 48 - protein, 6 aa, synthetic construct
HHHHHH

SEQ ID NO: 49 - protein, 8 aa, synthetic construct
HHHHHHHH

SEQ ID NO: 50 - skipped

SEQ ID NO: 51 - protein, 22 aa, synthetic construct
ELVVTQEPSLTVSPGGTVTLTC

SEQ ID NO: 52 - protein, 15 aa, synthetic construct
WVQQKPGQAPRGLIG

SEQ ID NO: 53 - protein, 32 aa, synthetic construct
GTPARFSGSLLGGKAALTLSGVQPEDEAVYYC

SEQ ID NO: 54 - protein, 32 aa, synthetic construct
GTPARFSGSSLGGKAALTLSGVQPEDEAVYYC

SEQ ID NO: 55 - protein, 32 aa, synthetic construct
GTPARFSGSLLGGSAALTLSGVQPEDEAVYYC

SEQ ID NO: 56 - protein, 32 aa, synthetic construct
GTPARFSGSSLGGSAALTLSGVQPEDEAVYYC

SEQ ID NO: 57 - protein, 32 aa, synthetic construct
GTPARFSGSLLGGKAALTLSGVQPEDEAEYYC

SEQ ID NO: 58 - protein, 32 aa, synthetic construct
GTPARFSGSSLGGSAALTLSGVQPEDEAEYYC

SEQ ID NO: 59 - protein, 10 aa, synthetic construct
FGGGTKLTVL

SEQ ID NO: 60 - protein, 25 aa, synthetic construct
EVQLLESGGGIVQPGGSLKLSCAAS

SEQ ID NO: 61 - protein, 25 aa, synthetic construct
EVQLQESGGGIVQPGGSLKLSCAAS

SEQ ID NO: 62 - protein, 25 aa, synthetic construct
EVQLQESGGGLVQPGGSLKLSCAAS

SEQ ID NO: 63 - protein, 25 aa, synthetic construct
EVQLLESGGGLVQPGGSLKLSCAAS

SEQ ID NO: 64 - protein, 14 aa, synthetic construct
WVRQAPGKGLEWVA

SEQ ID NO: 65 - protein, 32 aa, synthetic construct
RFTISRDDSKNTVYLQMNNLKTEDTAVYYCVR

SEQ ID NO: 66 - protein, 32 aa, synthetic construct
RFTISRDDSKNTAYLQMNNLKTEDTAVYYCVR

SEQ ID NO: 67 - protein, 11 aa, synthetic construct
WGQGTLVTVSS

SEQ ID NO: 68 - protein, 10 aa, synthetic construct
SPATSGSTPE

SEQ ID NO: 69 - protein, 8 aa, synthetic construct
GSAPATSE

SEQ ID NO: 70 - protein, 9 aa, synthetic construct
GSAPGTATE

SEQ ID NO: 71 - protein, 7 aa, synthetic construct
GSAPGTE

SEQ ID NO: 72 - protein, 8 aa, synthetic construct
PATSGPTE

SEQ ID NO: 73 - protein, 5 aa, synthetic construct
SASPE

SEQ ID NO: 74 - protein, 8 aa, synthetic construct
PATSGSTE

SEQ ID NO: 75 - protein, 9 aa, synthetic construct
GSAPGTSAE

SEQ ID NO: 76 - protein, 7 aa, synthetic construct
SATSGSE

SEQ ID NO: 77 - protein, 9 aa, synthetic construct
SGPGSTPAE

SEQ ID NO: 78 - protein, 11 aa, synthetic construct
SGPGSGPGTSE

SEQ ID NO: 79 - protein, 12 aa, synthetic construct
SGPGTSPSATPE

SEQ ID NO: 80 - skipped

SEQ ID NO: 81 - protein, 30 aa, synthetic construct
SESATPESGPGTSPGATPESGPGTSESATP

SEQ ID NO: 82 - protein, 30 aa, synthetic construct
GSGEGSEGEGGGEGSEGEGSGEGGEGEGSG

SEQ ID NO: 83 - protein, 32 aa, synthetic construct
TGSGEGSEGEGGGEGSEGEGSGEGGEGEGSGT

SEQ ID NO: 84 - protein, 30 aa, synthetic construct
GATPPETGAETESPGETTGGSAESEPPGEG

SEQ ID NO: 85 - protein, 30 aa, synthetic construct
GSAAPTAGTTPSASPAPPTGGSSAAGSPST

SEQ ID NO: 86 - protein, 6 aa, synthetic construct
SGGGGS

SEQ ID NO: 87 - protein, 5 aa, synthetic construct
GGGGS

SEQ ID NO: 88 - protein, 6 aa, synthetic construct
GGSGGS

SEQ ID NO: 89 - protein, 5 aa, synthetic construct
STEPS

SEQ ID NO: 90 - protein, 10 aa, synthetic construct
SATPESGPGT

SEQ ID NO: 91 - protein, 10 aa, synthetic construct
ATSGSETPGT

SEQ ID NO: 92 - protein, 10 aa, synthetic construct
GTAEAASASG

SEQ ID NO: 93 - protein, 13 aa, synthetic construct
STEPSEGSAPGTS

SEQ ID NO: 94 - protein, 6 aa, synthetic construct
SGPGTS

SEQ ID NO: 95 - protein, 7 aa, synthetic construct
GTSTEPS

SEQ ID NO: 96 - protein, 10 aa, synthetic construct
GTSESATPES

SEQ ID NO: 97 - protein, 10 aa, synthetic construct
GTATPESGPG

SEQ ID NO: 98-100 - skipped (3 entries)

SEQ ID NO: 101 - protein, 109 aa, synthetic construct
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL

SEQ ID NO: 102 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 103 - protein, 109 aa, synthetic construct
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVL

SEQ ID NO: 104 - protein, 109 aa, synthetic construct
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVL

SEQ ID NO: 105 - protein, 125 aa, synthetic construct
EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 106 - protein, 109 aa, synthetic construct
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVL

SEQ ID NO: 107 - protein, 109 aa, synthetic construct
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVL

SEQ ID NO: 108 - protein, 109 aa, synthetic construct
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 109 - protein, 125 aa, synthetic construct
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 110 - protein, 109 aa, synthetic construct
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVL

SEQ ID NO: 111 - protein, 125 aa, synthetic construct
EVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 112 - protein, 15 aa, synthetic construct
GGGGSGGGGSGGGGS

SEQ ID NO: 113 - protein, 18 aa, synthetic construct
GEGTSTGSGGSGGSGGAD

SEQ ID NO: 114 - protein, 18 aa, synthetic construct
VEGGSGGSGGSGGSGGVD

SEQ ID NO: 115 - protein, 29 aa, synthetic construct
RTSGPGDGGKGGPGKGPGGEGTKGTGPGG

SEQ ID NO: 116 - protein, 30 aa, synthetic construct; identical to SEQ ID NO: 82

SEQ ID NO: 117 - protein, 32 aa, synthetic construct; identical to SEQ ID NO: 83

SEQ ID NO: 118 - protein, 30 aa, synthetic construct; identical to SEQ ID NO: 84

SEQ ID NO: 119 - protein, 30 aa, synthetic construct; identical to SEQ ID NO: 85

SEQ ID NO: 120 - protein, 30 aa, synthetic construct
GEGGESGGSEGEGSGEGEGGSGGEGESEGG

SEQ ID NO: 121 - protein, 30 aa, synthetic construct
STETSPSTPTESPEAGSGSGSPESPSGTEA

SEQ ID NO: 122 - protein, 30 aa, synthetic construct
PTGTTGEPSGEGSEPEGSAPTSSTSEATPS

SEQ ID NO: 123 - protein, 30 aa, synthetic construct
SESESEGEAPTGPGASTTPEPSESPTPETS

SEQ ID NO: 124 - protein, 30 aa, synthetic construct
PEGGESGEGTGPGTGGEPEGEGGPGGEGGT

SEQ ID NO: 125 - protein, 9 aa, synthetic construct
GGGGSGGGS

SEQ ID NO: 126-178 - skipped (53 entries)

SEQ ID NO: 179 - protein, 12 aa, synthetic construct
GSETPSGPSETA

SEQ ID NO: 180 - protein, 12 aa, synthetic construct
GPSETSTSEPGA

SEQ ID NO: 181 - protein, 12 aa, synthetic construct
GSPSEPTEGTSA

SEQ ID NO: 182 - protein, 12 aa, synthetic construct
GESPGGSSGSES

SEQ ID NO: 183 - protein, 12 aa, synthetic construct
GSEGSSGPGESS

SEQ ID NO: 184 - protein, 12 aa, synthetic construct
GSSESGSSEGGP

SEQ ID NO: 185 - protein, 12 aa, synthetic construct
GSGGEPSESGSS

SEQ ID NO: 186 - protein, 12 aa, synthetic construct
GSPAGSPTSTEE

SEQ ID NO: 187 - protein, 12 aa, synthetic construct
GSEPATSGSETP

SEQ ID NO: 188 - protein, 12 aa, synthetic construct
GTSESATPESGP

SEQ ID NO: 189 - protein, 12 aa, synthetic construct
GTSTEPSEGSAP

SEQ ID NO: 190 - protein, 12 aa, synthetic construct
GSTSESPSGTAP

SEQ ID NO: 191 - protein, 12 aa, synthetic construct
GTSTPESGSASP

SEQ ID NO: 192 - protein, 12 aa, synthetic construct
GTSPSGESSTAP

SEQ ID NO: 193 - protein, 12 aa, synthetic construct
GSTSSTAESPGP

SEQ ID NO: 194 - protein, 12 aa, synthetic construct
GTPGSGTASSSP

SEQ ID NO: 195 - protein, 12 aa, synthetic construct
GSSTPSGATGSP

SEQ ID NO: 196 - protein, 12 aa, synthetic construct
GSSPSASTGTGP

SEQ ID NO: 197 - protein, 12 aa, synthetic construct
GASPGTSSTGSP

SEQ ID NO: 198 - protein, 12 aa, synthetic construct
GEPAGSPTSTSE

SEQ ID NO: 199 - protein, 12 aa, synthetic construct
GTGEPSSTPASE

SEQ ID NO: 200 - protein, 12 aa, synthetic construct
GSGPSTESAPTE

SEQ ID NO: 201 - protein, 264 aa, synthetic construct
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 202 - protein, 264 aa, synthetic construct
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 203 - protein, 264 aa, synthetic construct
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 204 - protein, 264 aa, synthetic construct
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 205 - protein, 264 aa, synthetic construct
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 206 - protein, 264 aa, synthetic construct
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 207 - protein, 264 aa, synthetic construct
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 208 - protein, 256 aa, synthetic construct
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 209 - protein, 255 aa, synthetic construct
QAGLTQPPSASGTPGQRVTLSCSGSYSNIGTYYVYWYQQLPGTAPKLLIYSNDQRLSGVPDRFSGSKSGTSASLAISGLQSEDEAAYYCAAWDDSLNGWAFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 210 - protein, 255 aa, synthetic construct
QPGLTQPPSASGTPGQRVTLSCSGRSSNIGSYYVYWYQHLPGMAPKLLIYRNSRRPSGVPDRFSGSKSGTSASLVISGLQSDDEADYYCAAWDDSLKSWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 211 - protein, 255 aa, synthetic construct
QSVLTQPPSASGTPGQRVTISCSGSSSNIGTNYVYWYQQFPGTAPKLLIYSNNQRPSGVPDRFSGSKSGTSGSLAISGLQSEDEADYSCAAWDDSLNGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 212 - protein, 255 aa, synthetic construct
QPGLTQPPSASGTPGQRVTISCSGSSSNIGSNYVYWYQQLPGTAPKLLIYRNNQRPSGVPDRLSGSKSGTSASLAISGLRSEDEADYYCAAWDDSLSGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 213 - protein, 256 aa, synthetic construct
QAVLTQPPSASGTPGQRVTISCSGSSSNIGSYYVYWYQQVPGAAPKLLMRLNNQRPSGVPDRFSGAKSGTSASLVISGLRSEDEADYYCAAWDDSLSGQWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 214 - protein, 255 aa, synthetic construct
QAGLTQPPSASGTPGQRVTISCSGSSSNIGSNYVYWYQQLPGTAPKLLIYRNNQRPSGVPDRFSGSKSGTSASLAISGLRSEDEADYYCATWDASLSGWVFGGGTKLTVLGATPPETGAETESPGETTGGSAESEPPGEGEVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 215 - protein, 264 aa, synthetic construct
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 216-300 - skipped (85 entries)

SEQ ID NO: 301 - protein, 119 aa, synthetic construct [sequence omitted]

SEQ ID NO: 302 - protein, 122 aa, synthetic construct [sequence omitted]

SEQ ID NO: 303 - protein, 119 aa, synthetic construct
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 304 - protein, 119 aa, synthetic construct [sequence omitted]

SEQ ID NO: 305 - protein, 119 aa, synthetic construct
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 306 - protein, 119 aa, synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 307 - protein, 125 aa, synthetic construct
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 308 - protein, 125 aa, synthetic construct
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 309 - protein, 125 aa, synthetic construct; identical to SEQ ID NO: 109

SEQ ID NO: 310 - protein, 125 aa, synthetic construct
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 311 - protein, 125 aa, synthetic construct
EVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 312-350 - skipped (39 entries)

SEQ ID NO: 351 - protein, 107 aa, synthetic construct
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 352 - protein, 107 aa, synthetic construct [sequence omitted]

SEQ ID NO: 353 - protein, 107 aa, synthetic construct
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 354 - protein, 107 aa, synthetic construct
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 355 - protein, 106 aa, synthetic construct
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 356 - protein, 106 aa, synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 357 - protein, 109 aa, synthetic construct
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 358 - protein, 109 aa, synthetic construct
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 359 - protein, 109 aa, synthetic construct; identical to SEQ ID NO: 108

SEQ ID NO: 360 - protein, 109 aa, synthetic construct
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 361 - protein, 109 aa, synthetic construct; identical to SEQ ID NO: 101

SEQ ID NO: 362-399 - skipped (38 entries)

SEQ ID NO: 400 - protein, 25 aa, synthetic construct
EVQLVESGGGIVQPGGSLRLSCAAS

SEQ ID NO: 401 - protein, 14 aa, synthetic construct
WVRQAPGKGLEWVG

SEQ ID NO: 402 - protein, 32 aa, synthetic construct
RFTISRDDSKNTVYLQMNSLKTEDTAVYYCVR

SEQ ID NO: 403-499 - skipped (97 entries)

SEQ ID NO: 500 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAASNKLYGRTWYDFNESDYWGQGTQVTVSS

SEQ ID NO: 501 - protein, 126 aa, synthetic construct
QVQLVESGGGVVQPGRSLRLSCAASGRTFGIYVWGWFRQAPGKEREFVGAISWSGSNRKVSDSVKGRFTISRDNSKNTLYLQMNSLRAEDTAVYFCAASNKLYGRTWYDFNESDYWGQGTQVTVSS

SEQ ID NO: 502 - protein, 126 aa, synthetic construct
QVQLVESGGGVVQPGRSLRLSCAASGRTFGIYVMGWFRQAPGKEREFVGAMSWSGSNRKVSDSVKGRFTISRDNSKNTLYLQMNSLRAEDTAVYFCAASNKLYGRTWYDFNESDYWGQGTQVTVSS

SEQ ID NO: 503 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCAASNKLYGRTWYDFNESDYWGQGTQVTVSS

SEQ ID NO: 504 - protein, 126 aa, synthetic construct
QVQLVESGGGVVQPGRSLRLSCAASGRTFGIYVWGWFRQAPGKEREFVGAISWSGSNRKVSDSVKGRFTISRDNSKNTLYLQMNSLRAEDTAVYYCAASNKLYGRTWYDFNESDYWGQGTQVTVSS

SEQ ID NO: 505 - protein, 126 aa, synthetic construct
QVQLVESGGGVVQPGRSLRLSCAASGRTFGIYVMGWFRQAPGKEREFVGAMSWSGSNRKVSDSVKGRFTISRDNSKNTLYLQMNSLRAEDTAVYYCAASNKLYGRTWYDFNESDYWGQGTQVTVSS

SEQ ID NO: 506 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKLYGRTWYDFNESDYWGQGTQVTVSS

SEQ ID NO: 507 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKWYGRTWYDFNESDYWGQGTQVTVSS

SEQ ID NO: 508 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCAASNKWYGRTWYDFNESDYWGQGTQVTVSS

SEQ ID NO: 509 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCGGSNKLYGRTWYDFNESDYWGQGTQVTVSS

SEQ ID NO: 510 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVDYCAASNKLYGRTWYDFNESDYWGQGTQVTVSS

SEQ ID NO: 511 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCGASNKLYGRTWYDFNESDYWGQGTQVTVSS

SEQ ID NO: 512 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNKRYGRTWYDFNESDYWGQGTQVTVSS

SEQ ID NO: 513 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNKDYGRTWYDFNESDYWGQGTQVTVSS

SEQ ID NO: 514 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNKEYGRTWYDFNESDYWGQGTQVTVSS

SEQ ID NO: 515 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNKGYGRTWYDFNESDYWGQGTQVTVSS

SEQ ID NO: 516 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVAYCAGSNKLYGRTWYDFNESDYWGQGTQVTVSS

SEQ ID NO: 517 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVRYCAGSNKLYGRTWYDFNESDYWGQGTQVTVSS

SEQ ID NO: 518 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVNYCAGSNKLYGRTWYDFNESDYWGQGTQVTVSS

SEQ ID NO: 519 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVGYCAGSNKLYGRTWYDFNESDYWGQGTQVTVSS

SEQ ID NO: 520 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVKYCAGSNKLYGRTWYDFNESDYWGQGTQVTVSS

SEQ ID NO: 521 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVSYCAGSNKLYGRTWYDFNESDYWGQGTQVTVSS

SEQ ID NO: 522 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVTYCAGSNKLYGRTWYDFNESDYWGQGTQVTVSS

SEQ ID NO: 523 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVAFCAASNKLYGRTWYDFNESDYWGQGTQVTVSS

SEQ ID NO: 524 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVRFCAASNKLYGRTWYDFNESDYWGQGTQVTVSS

SEQ ID NO: 525 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVNFCAASNKLYGRTWYDFNESDYWGQGTQVTVSS

SEQ ID NO: 526 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVDFCAASNKLYGRTWYDFNESDYWGQGTQVTVSS

SEQ ID NO: 527 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVGFCAASNKLYGRTWYDFNESDYWGQGTQVTVSS

SEQ ID NO: 528 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVKFCAASNKLYGRTWYDFNESDYWGQGTQVTVSS

SEQ ID NO: 529 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVSFCAASNKLYGRTWYDFNESDYWGQGTQVTVSS

SEQ ID NO: 530 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCGASNKLYGRTWYDFNESDYWGQGTQVTVSS

SEQ ID NO: 531 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAGSNKLYGRTWYDFNESDYWGQGTQVTVSS

SEQ ID NO: 532 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAASNKRYGRTWYDFNESDYWGQGTQVTVSS

SEQ ID NO: 533 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAASNKDYGRTWYDFNESDYWGQGTQVTVSS

SEQ ID NO: 534 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAASNKEYGRTWYDFNESDYWGQGTQVTVSS

SEQ ID NO: 535 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCAASNKGYGRTWYDFNESDYWGQGTQVTVSS

SEQ ID NO: 536 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVAFCAGSNKLYGRTWYDFNESDYWGQGTQVTVSS

SEQ ID NO: 537 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVRFCAGSNKLYGRTWYDFNESDYWGQGTQVTVSS

SEQ ID NO: 538 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVNFCAGSNKLYGRTWYDFNESDYWGQGTQVTVSS

SEQ ID NO: 539 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVGFCAGSNKLYGRTWYDFNESDYWGQGTQVTVSS

SEQ ID NO: 540 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVKFCAGSNKLYGRTWYDFNESDYWGQGTQVTVSS

SEQ ID NO: 541 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVSFCAGSNKLYGRTWYDFNESDYWGQGTQVTVSS

SEQ ID NO: 542 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVTFCAGSNKLYGRTWYDFNESDYWGQGTQVTVSS

SEQ ID NO: 543 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYFCGGSNKLYGRTWYDFNESDYWGQGTQVTVSS

SEQ ID NO: 544 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCGGSNKLYGRTWYDFNESDYWGQGTQVTVSS

SEQ ID NO: 545 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVDYCAASNKLYGRTWYDFNESDYWGQGTQVTVSS

SEQ ID NO: 546 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCGASNKLYGRTWYDFNESDYWGQGTQVTVSS

SEQ ID NO: 547 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKRYGRTWYDFNESDYWGQGTQVTVSS

SEQ ID NO: 548 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKDYGRTWYDFNESDYWGQGTQVTVSS

SEQ ID NO: 549 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSS

SEQ ID NO: 550 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKGYGRTWYDFNESDYWGQGTQVTVSS

SEQ ID NO: 551 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVDFCAASNKLYGRTWYDFNESDYWGQGTQVTVSS

SEQ ID NO: 552 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCGASNKLYGRTWYDFNESDYWGQGTQVTVSS

SEQ ID NO: 553 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCAASNKRYGRTWYDFNESDYWGQGTQVTVSS

SEQ ID NO: 554 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCAASNKDYGRTWYDFNESDYWGQGTQVTVSS

SEQ ID NO: 555 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCAASNKEYGRTWYDFNESDYWGQGTQVTVSS

SEQ ID NO: 556 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCAASNKGYGRTWYDFNESDYWGQGTQVTVSS

SEQ ID NO: 557 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYFCGGSNKLYGRTWYDFNESDYWGQGTQVTVSS

SEQ ID NO: 558 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVRYCAGSNKLYGRTWYDFNESDYWGQGTQVTVSS

SEQ ID NO: 559 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVNYCAGSNKLYGRTWYDFNESDYWGQGTQVTVSS

SEQ ID NO: 560 - protein, 121 aa, synthetic construct
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 561 - protein, 107 aa, synthetic construct
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 562 - protein, 121 aa, synthetic construct
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSS

SEQ ID NO: 563 - protein, 107 aa, synthetic construct
DIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 564 - protein, 243 aa, synthetic construct
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 565 - protein, 243 aa, synthetic construct
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIK

SEQ ID NO: 566 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRALDTAVYYCAASNKEYGRTWYDFNESDYWGQGTQVTVSS

SEQ ID NO: 567 - protein, 127 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSA

SEQ ID NO: 568 - protein, 128 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSAA

SEQ ID NO: 569 - protein, 129 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSAAA

SEQ ID NO: 570 - protein, 130 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSAAAA

SEQ ID NO: 571 - protein, 131 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSAAAAA

SEQ ID NO: 572 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDKNESDYWGQGTQVTVSS

SEQ ID NO: 573 - protein, 126 aa, synthetic construct
QVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDQNESDYWGQGTQVTVSS

SEQ ID NO: 574 - protein, 5 aa, synthetic construct
VTVSS

SEQ ID NO: 575 - protein, 5 aa, synthetic construct
VKVSS

SEQ ID NO: 576 - protein, 5 aa, synthetic construct
VQVSS

SEQ ID NO: 577 - protein, 5 aa, synthetic construct
VTVKS

SEQ ID NO: 578 - protein, 5 aa, synthetic construct
VTVQS

SEQ ID NO: 579 - protein, 5 aa, synthetic construct
VKVKS

SEQ ID NO: 580 - protein, 5 aa, synthetic construct
VKVQS

SEQ ID NO: 581 - protein, 5 aa, synthetic construct
VQVKS

SEQ ID NO: 582 - protein, 5 aa, synthetic construct
VQVQS

SEQ ID NO: 583 - protein, 6 aa, synthetic construct
VTVSSA

SEQ ID NO: 584 - protein, 6 aa, synthetic construct
VKVSSA

SEQ ID NO: 585 - protein, 6 aa, synthetic construct
VQVSSA

SEQ ID NO: 586 - protein, 6 aa, synthetic construct
VTVKSA

SEQ ID NO: 587 - protein, 6 aa, synthetic construct
VTVQSA

SEQ ID NO: 588 - protein, 6 aa, synthetic construct
VKVKSA

SEQ ID NO: 589 - protein, 6 aa, synthetic construct
VKVQSA

SEQ ID NO: 590 - protein, 6 aa, synthetic construct
VQVKSA

SEQ ID NO: 591 - protein, 6 aa, synthetic construct
VQVQSA

SEQ ID NO: 592-600 - skipped (9 entries)

SEQ ID NO: 601 - protein, 144 aa, synthetic construct
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 602 - protein, 144 aa, synthetic construct
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 603 - protein, 144 aa, synthetic construct
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 604 - protein, 144 aa, synthetic construct; identical to SEQ ID NO: 603

SEQ ID NO: 605 - protein, 144 aa, synthetic construct
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 606 - protein, 144 aa, synthetic construct; identical to SEQ ID NO: 605

SEQ ID NO: 607 - protein, 144 aa, synthetic construct
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 608 - protein, 144 aa, synthetic construct; identical to SEQ ID NO: 607

SEQ ID NO: 609 - protein, 144 aa, synthetic construct
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 610 - protein, 144 aa, synthetic construct
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 611 - protein, 288 aa, synthetic construct
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 612 - protein, 288 aa, synthetic construct
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 613 - protein, 576 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 614 - protein, 625 aa, synthetic construct
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 615 - protein, 864 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 616 - protein, 865 aa, synthetic construct
GGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 617 - protein, 866 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 618 - protein, 1152 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 619 - protein, 144 aa, synthetic construct
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 620 - protein, 144 aa, synthetic construct
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 621 - protein, 180 aa, synthetic construct
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 622 - protein, 216 aa, synthetic construct
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 623 - protein, 252 aa, synthetic construct
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 624 - protein, 288 aa, synthetic construct
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 625 - protein, 324 aa, synthetic construct
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 626 - protein, 360 aa, synthetic construct
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 627 - protein, 360 aa, synthetic construct
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 628 - protein, 432 aa, synthetic construct
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 629 - protein, 468 aa, synthetic construct
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 630 - protein, 504 aa, synthetic construct
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 631 - protein, 540 aa, synthetic construct
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 632 - protein, 576 aa, synthetic construct
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 633 - protein, 612 aa, synthetic construct
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 634 - protein, 648 aa, synthetic construct
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 635 - protein, 684 aa, synthetic construct
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 636 - protein, 720 aa, synthetic construct
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 637 - protein, 756 aa, synthetic construct
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 638 - protein, 792 aa, synthetic construct
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 639 - protein, 828 aa, synthetic construct
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 640 - protein, 869 aa, synthetic construct
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 641 - protein, 144 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 642 - protein, 288 aa, synthetic construct
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 643 - protein, 432 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 644 - protein, 576 aa, synthetic construct
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 645 - protein, 864 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 646 - protein, 712 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEAHHH

SEQ ID NO: 647 - protein, 864 aa, synthetic construct
GSPGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 648 - protein, 288 aa, synthetic construct
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPG

SEQ ID NO: 649 - protein, 284 aa, synthetic construct
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 650 - protein, 292 aa, synthetic construct
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 651 - protein, 864 aa, synthetic construct
AGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 652 - protein, 867 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 653 - protein, 867 aa, synthetic construct
SPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 654 - protein, 868 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 655 - protein, 144 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAP

SEQ ID NO: 656 - protein, 292 aa, synthetic construct; identical to SEQ ID NO: 650

SEQ ID NO: 657 - protein, 293 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPEGAAEPEA

SEQ ID NO: 658 - protein, 300 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGAAEPEA

SEQ ID NO: 659 - protein, 584 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 660-699 - skipped (40 entries)

SEQ ID NO: 700 - protein, 109 aa, synthetic construct; identical to SEQ ID NO: 101

SEQ ID NO: 701 - protein, 125 aa, synthetic construct
EVQLLESGGGIVQPGGSLRLSCAASGFTFNTYAMNWVRQAPGKGLEWVGRIRSKRNNYATYYADSVKGRFTISRDDSKNTVYLQMNSLKTEDTAVYYCVRHENFGNSYVSWFAHWGQGTLVTVSS

SEQ ID NO: 702 - protein, 109 aa, synthetic construct; identical to SEQ ID NO: 101

SEQ ID NO: 703 - protein, 125 aa, synthetic construct
EVQLVESGGGIVQPGGSLRLSCAASGFTFNTYAMNWVRQAPGKGLEWVGRIRSKRNNYATYYADSVKGRFTISRDDSKNTVYLQMNSLKTEDTAVYYCVRHENFGNSYVSWFAHWGQGTLVTVSS

SEQ ID NO: 704 - protein, 109 aa, synthetic construct; identical to SEQ ID NO: 101

SEQ ID NO: 705 - protein, 125 aa, synthetic construct
EVQLLESGGGIVQPGGSLRLSCAASGFTFNTYAMNWVRQAPGKGLEWVGRIRSKTNNYATYYADSVKGRFTISRDDSKNTVYLQMNSLKTEDTAVYYCVRHENFGNSYVSWFAHWGQGTLVTVSS

SEQ ID NO: 706 - protein, 109 aa, synthetic construct; identical to SEQ ID NO: 101

SEQ ID NO: 707 - protein, 125 aa, synthetic construct
EVQLVESGGGIVQPGGSLRLSCAASGFTFNTYAMNWVRQAPGKGLEWVGRIRSKTNNYATYYADSVKGRFTISRDDSKNTVYLQMNSLKTEDTAVYYCVRHENFGNSYVSWFAHWGQGTLVTVSS

SEQ ID NO: 708 - protein, 109 aa, synthetic construct; identical to SEQ ID NO: 101

SEQ ID NO: 709 - protein, 125 aa, synthetic construct
EVQLLESGGGIVQPGGSLRLSCAASGFTFNTYAMNWVRQAPGKGLEWVGRIRSKYNDYATYYADSVKGRFTISRDDSKNTVYLQMNSLKTEDTAVYYCVRHENFGNSYVSWFAHWGQGTLVTVSS

SEQ ID NO: 710 - protein, 109 aa, synthetic construct; identical to SEQ ID NO: 101

SEQ ID NO: 711 - protein, 125 aa, synthetic construct
EVQLVESGGGIVQPGGSLRLSCAASGFTFNTYAMNWVRQAPGKGLEWVGRIRSKYNDYATYYADSVKGRFTISRDDSKNTVYLQMNSLKTEDTAVYYCVRHENFGNSYVSWFAHWGQGTLVTVSS

SEQ ID NO: 712 - protein, 109 aa, synthetic construct; identical to SEQ ID NO: 101

SEQ ID NO: 713 - protein, 125 aa, synthetic construct
EVQLLESGGGIVQPGGSLRLSCAASGFTFNTYAMNWVRQAPGKGLEWVGRIRSKYNNYATTYADSVKGRFTISRDDSKNTVYLQMNSLKTEDTAVYYCVRHENFGNSYVSWFAHWGQGTLVTVSS

SEQ ID NO: 714 - protein, 109 aa, synthetic construct; identical to SEQ ID NO: 101

SEQ ID NO: 715 - protein, 125 aa, synthetic construct
EVQLVESGGGIVQPGGSLRLSCAASGFTFNTYAMNWVRQAPGKGLEWVGRIRSKYNNYATTYADSVKGRFTISRDDSKNTVYLQMNSLKTEDTAVYYCVRHENFGNSYVSWFAHWGQGTLVTVSS

SEQ ID NO: 716 - protein, 109 aa, synthetic construct; identical to SEQ ID NO: 101

SEQ ID NO: 717 - protein, 125 aa, synthetic construct
EVQLVESGGGIVQPGGSLRLSCAASGFTFNTYAMNWVRQAPGKGLEWVGRIRSKRNNYATYYADSVKGRFTISRDDSKNTVYLQMNELKTEDTAVYYCVRHENFGNSYVSWFAHWGQGTLVTVSS

SEQ ID NO: 718 - protein, 109 aa, synthetic construct; identical to SEQ ID NO: 101

SEQ ID NO: 719 - protein, 125 aa, synthetic construct
EVQLVESGGGIVQPGGSLRLSCAASGFTFSTYAMNWVRQAPGKGLEWVGRIRSKRNNYATYYADSVKGRFTISRDDSKNTVYLQMNELKTEDTAVYYCVRHENFGNSYVSWFAHWGQGTLVTVSS

SEQ ID NO: 720 - protein, 109 aa, synthetic construct; identical to SEQ ID NO: 101

SEQ ID NO: 721 - protein, 125 aa, synthetic construct
EVQLVESGGGIVQPGGSLRLSCAASGFTFNTYAMNWVRQAPGKGLEWVGRIRSKTNNYATYYADSVKGRFTISRDDSKNTVYLQMNELKTEDTAVYYCVRHENFGNSYVSWFAHWGQGTLVTVSS

SEQ ID NO: 722 - protein, 109 aa, synthetic construct; identical to SEQ ID NO: 101

SEQ ID NO: 723 - protein, 125 aa, synthetic construct
EVQLVESGGGIVQPGGSLRLSCAASGFTFSTYAMNWVRQAPGKGLEWVGRIRSKTNNYATYYADSVKGRFTISRDDSKNTVYLQMNELKTEDTAVYYCVRHENFGNSYVSWFAHWGQGTLVTVSS

SEQ ID NO: 724 - protein, 109 aa, synthetic construct; identical to SEQ ID NO: 101

SEQ ID NO: 725 - protein, 125 aa, synthetic construct
EVQLVESGGGIVQPGGSLRLSCAASGFTFNTYAMNWVRQAPGKGLEWVGRIRSKYNDYATYYADSVKGRFTISRDDSKNTVYLQMNELKTEDTAVYYCVRHENFGNSYVSWFAHWGQGTLVTVSS

SEQ ID NO: 726 - protein, 109 aa, synthetic construct; identical to SEQ ID NO: 101

SEQ ID NO: 727 - protein, 125 aa, synthetic construct
EVQLVESGGGIVQPGGSLRLSCAASGFTFSTYAMNWVRQAPGKGLEWVGRIRSKYNDYATYYADSVKGRFTISRDDSKNTVYLQMNELKTEDTAVYYCVRHENFGNSYVSWFAHWGQGTLVTVSS

SEQ ID NO: 728 - protein, 109 aa, synthetic construct; identical to SEQ ID NO: 101

SEQ ID NO: 729 - protein, 125 aa, synthetic construct
EVQLVESGGGIVQPGGSLRLSCAASGFTFSTYAMNWVRQAPGKGLEWVGRIRSKRNNYATYYADSVKGRFTISRDDSKNTVYLQMNSLKTEDTAVYYCVRHENFGNSYVSWFAHWGQGTLVTVSS

SEQ ID NO: 730 - protein, 109 aa, synthetic construct; identical to SEQ ID NO: 101

SEQ ID NO: 731 - protein, 125 aa, synthetic construct
EVQLVESGGGIVQPGGSLRLSCAASGFTFSTYAMNWVRQAPGKGLEWVGRIRSKTNNYATYYADSVKGRFTISRDDSKNTVYLQMNSLKTEDTAVYYCVRHENFGNSYVSWFAHWGQGTLVTVSS

SEQ ID NO: 732 - protein, 109 aa, synthetic construct; identical to SEQ ID NO: 101

SEQ ID NO: 733 - protein, 125 aa, synthetic construct
EVQLVESGGGIVQPGGSLRLSCAASGFTFSTYAMNWVRQAPGKGLEWVGRIRSKYNDYATYYADSVKGRFTISRDDSKNTVYLQMNSLKTEDTAVYYCVRHENFGNSYVSWFAHWGQGTLVTVSS

SEQ ID NO: 734 - protein, 109 aa, synthetic construct; identical to SEQ ID NO: 101

SEQ ID NO: 735 - protein, 125 aa, synthetic construct
EVQLVESGGGIVQPGGSLRLSCAASGFTFSTYAMNWVRQAPGKGLEWVGRIRSKYNNYATTYADSVKGRFTISRDDSKNTVYLQMNSLKTEDTAVYYCVRHENFGNSYVSWFAHWGQGTLVTVSS

SEQ ID NO: 736 - protein, 109 aa, synthetic construct; identical to SEQ ID NO: 101

SEQ ID NO: 737 - protein, 125 aa, synthetic construct
EVQLVESGGGIVQPGGSLRLSCAASGFTFNTYAMNWVRQAPGKGLEWVGRIRTKRNNYATYYADSVKGRFTISRDDSKNTVYLQMNELKTEDTAVYYCVRHENFGNSYVSWFAHWGQGTLVTVSS

SEQ ID NO: 738 - protein, 109 aa, synthetic construct; identical to SEQ ID NO: 101

SEQ ID NO: 739 - protein, 125 aa, synthetic construct
EVQLVESGGGIVQPGGSLRLSCAASGFTFSTYAMNWVRQAPGKGLEWVGRIRTKRNNYATYYADSVKGRFTISRDDSKNTVYLQMNELKTEDTAVYYCVRHENFGNSYVSWFAHWGQGTLVTVSS

SEQ ID NO: 740 - protein, 109 aa, synthetic construct; identical to SEQ ID NO: 101

SEQ ID NO: 741 - protein, 125 aa, synthetic construct
EVQLVESGGGIVQPGGSLRLSCAASGFTFNTYAMNWVRQAPGKGLEWVGRIRTKTNNYATYYADSVKGRFTISRDDSKNTVYLQMNELKTEDTAVYYCVRHENFGNSYVSWFAHWGQGTLVTVSS

SEQ ID NO: 742 - protein, 109 aa, synthetic construct; identical to SEQ ID NO: 101

SEQ ID NO: 743 - protein, 125 aa, synthetic construct
EVQLVESGGGIVQPGGSLRLSCAASGFTFSTYAMNWVRQAPGKGLEWVGRIRTKTNNYATYYADSVKGRFTISRDDSKNTVYLQMNELKTEDTAVYYCVRHENFGNSYVSWFAHWGQGTLVTVSS

SEQ ID NO: 744 - protein, 109 aa, synthetic construct; identical to SEQ ID NO: 101

SEQ ID NO: 745 - protein, 125 aa, synthetic construct
EVQLVESGGGIVQPGGSLRLSCAASGFTFNTYAMNWVRQAPGKGLEWVGRIRTKYNDYATYYADSVKGRFTISRDDSKNTVYLQMNELKTEDTAVYYCVRHENFGNSYVSWFAHWGQGTLVTVSS

SEQ ID NO: 746 - protein, 109 aa, synthetic construct; identical to SEQ ID NO: 101

SEQ ID NO: 747 - protein, 125 aa, synthetic construct
EVQLVESGGGIVQPGGSLRLSCAASGFTFSTYAMNWVRQAPGKGLEWVGRIRTKYNDYATYYADSVKGRFTISRDDSKNTVYLQMNELKTEDTAVYYCVRHENFGNSYVSWFAHWGQGTLVTVSS

SEQ ID NO: 748 - protein, 109 aa, synthetic construct; identical to SEQ ID NO: 101

SEQ ID NO: 749 - protein, 125 aa, synthetic construct
EVQLVESGGGIVQPGGSLRLSCAASGFTFNTYAMNWVRQAPGKGLEWVGRIRTKYNNYATTYADSVKGRFTISRDDSKNTVYLQMNELKTEDTAVYYCVRHENFGNSYVSWFAHWGQGTLVTVSS

SEQ ID NO: 750 - protein, 109 aa, synthetic construct; identical to SEQ ID NO: 101

SEQ ID NO: 751 - protein, 125 aa, synthetic construct
EVQLVESGGGIVQPGGSLRLSCAASGFTFSTYAMNWVRQAPGKGLEWVGRIRTKYNNYATTYADSVKGRFTISRDDSKNTVYLQMNELKTEDTAVYYCVRHENFGNSYVSWFAHWGQGTLVTVSS

SEQ ID NO: 752 - protein, 109 aa, synthetic construct; identical to SEQ ID NO: 101

SEQ ID NO: 753 - protein, 125 aa, synthetic construct
EVQLVESGGGIVQPGGSLRLSCAASGFTFNTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 754 - protein, 109 aa, synthetic construct; identical to SEQ ID NO: 101

SEQ ID NO: 755 - protein, 125 aa, synthetic construct; identical to SEQ ID NO: 311

SEQ ID NO: 756 - protein, 109 aa, synthetic construct; identical to SEQ ID NO: 101

SEQ ID NO: 757 - protein, 125 aa, synthetic construct
EVQLVESGGGIVQPGGSLRLSCAASGFTFNTYAMNWVRQAPGKGLEWVGRIRTKTNNYATYYADSVKGRFTISRDDSKNTVYLQMNSLKTEDTAVYYCVRHENFGNSYVSWFAHWGQGTLVTVSS

SEQ ID NO: 758 - protein, 109 aa, synthetic construct; identical to SEQ ID NO: 101

SEQ ID NO: 759 - protein, 125 aa, synthetic construct
EVQLVESGGGIVQPGGSLRLSCAASGFTFSTYAMNWVRQAPGKGLEWVGRIRTKTNNYATYYADSVKGRFTISRDDSKNTVYLQMNSLKTEDTAVYYCVRHENFGNSYVSWFAHWGQGTLVTVSS

SEQ ID NO: 760 - protein, 109 aa, synthetic construct; identical to SEQ ID NO: 101

SEQ ID NO: 761 - protein, 125 aa, synthetic construct
EVQLVESGGGIVQPGGSLRLSCAASGFTFNTYAMNWVRQAPGKGLEWVGRIRTKYNDYATYYADSVKGRFTISRDDSKNTVYLQMNSLKTEDTAVYYCVRHENFGNSYVSWFAHWGQGTLVTVSS

SEQ ID NO: 762 - protein, 109 aa, synthetic construct; identical to SEQ ID NO: 101

SEQ ID NO: 763 - protein, 125 aa, synthetic construct
EVQLVESGGGIVQPGGSLRLSCAASGFTFSTYAMNWVRQAPGKGLEWVGRIRTKYNDYATYYADSVKGRFTISRDDSKNTVYLQMNSLKTEDTAVYYCVRHENFGNSYVSWFAHWGQGTLVTVSS

SEQ ID NO: 764 - protein, 109 aa, synthetic construct; identical to SEQ ID NO: 101

SEQ ID NO: 765 - protein, 125 aa, synthetic construct
EVQLVESGGGIVQPGGSLRLSCAASGFTFNTYAMNWVRQAPGKGLEWVGRIRTKYNNYATTYADSVKGRFTISRDDSKNTVYLQMNSLKTEDTAVYYCVRHENFGNSYVSWFAHWGQGTLVTVSS

SEQ ID NO: 766 - protein, 109 aa, synthetic construct; identical to SEQ ID NO: 101

SEQ ID NO: 767 - protein, 125 aa, synthetic construct
EVQLVESGGGIVQPGGSLRLSCAASGFTFSTYAMNWVRQAPGKGLEWVGRIRTKYNNYATTYADSVKGRFTISRDDSKNTVYLQMNSLKTEDTAVYYCVRHENFGNSYVSWFAHWGQGTLVTVSS

SEQ ID NO: 768 - protein, 109 aa, synthetic construct; identical to SEQ ID NO: 101

SEQ ID NO: 769 - protein, 125 aa, synthetic construct
EVQLVESGGGIVQPGGSLRLSCAASGFTFNTYAMNWVRQAPGKGLEWVGRIRSKYNEYATYYADSVKGRFTISRDDSKNTVYLQMNSLKTEDTAVYYCVRHENFGNSYVSWFAHWGQGTLVTVSS

SEQ ID NO: 770 - protein, 109 aa, synthetic construct; identical to SEQ ID NO: 101

SEQ ID NO: 771 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTVYLQMNSLKTEDTAVYYCVRHENFGNSYVSWFAHWGQGTLVTVSS

SEQ ID NO: 772 - protein, 109 aa, synthetic construct; identical to SEQ ID NO: 101

SEQ ID NO: 773 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTVYLQMNELKTEDTAVYYCVRHENFGNSYVSWFAHWGQGTLVTVSS

SEQ ID NO: 774 - protein, 109 aa, synthetic construct; identical to SEQ ID NO: 101

SEQ ID NO: 775 - protein, 125 aa, synthetic construct
EVQLVESGGGIVQPGGSLRLSCAASGFTFNTYAMNWVRQAPGKGLEWVARIRTKYNNYATTYADSVKDRFTISRDDSKNTVYLQMNSLKTEDTAVYYCVRHENFGNSYVSWFAHWGQGTLVTVSS

SEQ ID NO: 776 - protein, 109 aa, synthetic construct; identical to SEQ ID NO: 101

SEQ ID NO: 777 - protein, 125 aa, synthetic construct
EVQLVESGGGIVQPGGSLRLSCAASGFTFNTYAMNWVRQAPGKGLEWVARIRSKRNNYATTYADSVKDRFTISRDDSKNTVYLQMNSLKTEDTAVYYCVRHENFGNSYVSWFAHWGQGTLVTVSS

SEQ ID NO: 778 - protein, 109 aa, synthetic construct; identical to SEQ ID NO: 101

SEQ ID NO: 779 - protein, 125 aa, synthetic construct
EVQLVESGGGIVQPGGSLRLSCAASGFTFNTYAMNWVRQAPGKGLEWVARIRSKKNNYATTYADSVKDRFTISRDDSKNTVYLQMNSLKTEDTAVYYCVRHENFGNSYVSWFAHWGQGTLVTVSS

SEQ ID NO: 780 - protein, 109 aa, synthetic construct; identical to SEQ ID NO: 101

SEQ ID NO: 781 - protein, 125 aa, synthetic construct
EVQLVESGGGIVQPGGSLRLSCAASGFTFNTYAMNWVRQAPGKGLEWVARIRSKTNNYATTYADSVKDRFTISRDDSKNTVYLQMNSLKTEDTAVYYCVRHENFGNSYVSWFAHWGQGTLVTVSS

SEQ ID NO: 782 - protein, 109 aa, synthetic construct; identical to SEQ ID NO: 101

SEQ ID NO: 783 - protein, 125 aa, synthetic construct
EVQLVESGGGIVQPGGSLRLSCAASGFTFNTYAMNWVRQAPGKGLEWVGRIRSKYNDYATYYADSVKGRFTISRDDSKNTLYLQMNSLKTEDTAVYYCVRHENFGNSYVSWFAHWGQGTLVTVSS

SEQ ID NO: 784 - protein, 109 aa, synthetic construct; identical to SEQ ID NO: 101

SEQ ID NO: 785 - protein, 125 aa, synthetic construct
EVQLVESGGGIVQPGGSLRLSCAASGFTFNTYAMNWVRQAPGKGLEWVGRIRSKYNEYATYYADSVKGRFTISRDDSKNTLYLQMNSLKTEDTAVYYCVRHENFGNSYVSWFAHWGQGTLVTVSS

SEQ ID NO: 786 - protein, 109 aa, synthetic construct; identical to SEQ ID NO: 101

SEQ ID NO: 787 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTLYLQMNSLKTEDTAVYYCVRHENFGNSYVSWFAHWGQGTLVTVSS

SEQ ID NO: 788 - protein, 109 aa, synthetic construct; identical to SEQ ID NO: 101

SEQ ID NO: 789 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTLYLQMNELKTEDTAVYYCVRHENFGNSYVSWFAHWGQGTLVTVSS

SEQ ID NO: 790 - protein, 109 aa, synthetic construct; identical to SEQ ID NO: 101

SEQ ID NO: 791 - protein, 125 aa, synthetic construct
EVQLVESGGGIVQPGGSLRLSCAASGFTFNTYAMNWVRQAPGKGLEWVARIRTKYNNYATTYADSVKDRFTISRDDSKNTLYLQMNSLKTEDTAVYYCVRHENFGNSYVSWFAHWGQGTLVTVSS

SEQ ID NO: 792 - protein, 109 aa, synthetic construct; identical to SEQ ID NO: 101

SEQ ID NO: 793 - protein, 125 aa, synthetic construct
EVQLVESGGGIVQPGGSLRLSCAASGFTFNTYAMNWVRQAPGKGLEWVARIRSKRNNYATTYADSVKDRFTISRDDSKNTLYLQMNSLKTEDTAVYYCVRHENFGNSYVSWFAHWGQGTLVTVSS

SEQ ID NO: 794 - protein, 109 aa, synthetic construct; identical to SEQ ID NO: 101

SEQ ID NO: 795 - protein, 125 aa, synthetic construct
EVQLVESGGGIVQPGGSLRLSCAASGFTFNTYAMNWVRQAPGKGLEWVARIRSKKNNYATTYADSVKDRFTISRDDSKNTLYLQMNSLKTEDTAVYYCVRHENFGNSYVSWFAHWGQGTLVTVSS

SEQ ID NO: 796 - protein, 109 aa, synthetic construct; identical to SEQ ID NO: 101

SEQ ID NO: 797 - protein, 125 aa, synthetic construct
EVQLVESGGGIVQPGGSLRLSCAASGFTFNTYAMNWVRQAPGKGLEWVARIRSKTNNYATTYADSVKDRFTISRDDSKNTLYLQMNSLKTEDTAVYYCVRHENFGNSYVSWFAHWGQGTLVTVSS

SEQ ID NO: 798 - protein, 109 aa, synthetic construct; identical to SEQ ID NO: 101

SEQ ID NO: 799 - protein, 125 aa, synthetic construct
EVQLVESGGGIVQPGGSLRLSCAASGFTFNTYAMNWVRQAPGKGLEWVGRIRTKYNNYATTYADSVKDRFTISRDDSKNTVYLQMNSLKTEDTAVYYCVRHENFGNSYVSWFAHWGQGTLVTVSS

SEQ ID NO: 800 - protein, 109 aa, synthetic construct; identical to SEQ ID NO: 101

SEQ ID NO: 801 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTVYLQMNSLKTEDTAVYYCVRHENFGNSYVSWFAHWGQGTLVTVSS

SEQ ID NO: 802 - protein, 109 aa, synthetic construct; identical to SEQ ID NO: 101

SEQ ID NO: 803 - protein, 125 aa, synthetic construct
EVQLVESGGGIVQPGGSLRLSCAASGFTFNTYAMNWVRQAPGKGLEWVGRIRSKKNNYATTYADSVKDRFTISRDDSKNTVYLQMNSLKTEDTAVYYCVRHENFGNSYVSWFAHWGQGTLVTVSS

SEQ ID NO: 804 - protein, 109 aa, synthetic construct; identical to SEQ ID NO: 101

SEQ ID NO: 805 - protein, 125 aa, synthetic construct
EVQLVESGGGIVQPGGSLRLSCAASGFTFNTYAMNWVRQAPGKGLEWVGRIRSKTNNYATTYADSVKDRFTISRDDSKNTVYLQMNSLKTEDTAVYYCVRHENFGNSYVSWFAHWGQGTLVTVSS

SEQ ID NO: 806 - protein, 109 aa, synthetic construct; identical to SEQ ID NO: 101

SEQ ID NO: 807 - protein, 125 aa, synthetic construct
EVQLVESGGGIVQPGGSLRLSCAASGFTFNTYAMNWVRQAPGKGLEWVGRIRTKYNNYATTYADSVKDRFTISRDDSKNTVYLQMNELKTEDTAVYYCVRHENFGNSYVSWFAHWGQGTLVTVSS

SEQ ID NO: 808 - protein, 109 aa, synthetic construct; identical to SEQ ID NO: 101

SEQ ID NO: 809 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTVYLQMNELKTEDTAVYYCVRHENFGNSYVSWFAHWGQGTLVTVSS

SEQ ID NO: 810 - protein, 109 aa, synthetic construct; identical to SEQ ID NO: 101

SEQ ID NO: 811 - protein, 125 aa, synthetic construct
EVQLVESGGGIVQPGGSLRLSCAASGFTFNTYAMNWVRQAPGKGLEWVGRIRSKKNNYATTYADSVKDRFTISRDDSKNTVYLQMNELKTEDTAVYYCVRHENFGNSYVSWFAHWGQGTLVTVSS

SEQ ID NO: 812 - protein, 109 aa, synthetic construct; identical to SEQ ID NO: 101

SEQ ID NO: 813 - protein, 125 aa, synthetic construct
EVQLVESGGGIVQPGGSLRLSCAASGFTFNTYAMNWVRQAPGKGLEWVGRIRSKTNNYATTYADSVKDRFTISRDDSKNTVYLQMNELKTEDTAVYYCVRHENFGNSYVSWFAHWGQGTLVTVSS

SEQ ID NO: 814 - protein, 109 aa, synthetic construct; identical to SEQ ID NO: 101

SEQ ID NO: 815 - protein, 125 aa, synthetic construct
EVQLVESGGGIVQPGGSLRLSCAASGFTFNTYAMNWVRQAPGKGLEWVGRIRTKYNNYATTYADSVKDRFTISRDDSKNTLYLQMNSLKTEDTAVYYCVRHENFGNSYVSWFAHWGQGTLVTVSS

SEQ ID NO: 816 - protein, 109 aa, synthetic construct; identical to SEQ ID NO: 101

SEQ ID NO: 817 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTLYLQMNSLKTEDTAVYYCVRHENFGNSYVSWFAHWGQGTLVTVSS

SEQ ID NO: 818 - protein, 109 aa, synthetic construct; identical to SEQ ID NO: 101

SEQ ID NO: 819 - protein, 125 aa, synthetic construct
EVQLVESGGGIVQPGGSLRLSCAASGFTFNTYAMNWVRQAPGKGLEWVGRIRSKKNNYATTYADSVKDRFTISRDDSKNTLYLQMNSLKTEDTAVYYCVRHENFGNSYVSWFAHWGQGTLVTVSS

SEQ ID NO: 820 - protein, 109 aa, synthetic construct; identical to SEQ ID NO: 101

SEQ ID NO: 821 - protein, 125 aa, synthetic construct
EVQLVESGGGIVQPGGSLRLSCAASGFTFNTYAMNWVRQAPGKGLEWVGRIRSKTNNYATTYADSVKDRFTISRDDSKNTLYLQMNSLKTEDTAVYYCVRHENFGNSYVSWFAHWGQGTLVTVSS

SEQ ID NO: 822 - protein, 109 aa, synthetic construct; identical to SEQ ID NO: 101

SEQ ID NO: 823 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTLYLQMNELKTEDTAVYYCVRHENFGNSYVSWFAHWGQGTLVTVSS

SEQ ID NO: 824 - protein, 109 aa, synthetic construct; identical to SEQ ID NO: 101

SEQ ID NO: 825 - protein, 125 aa, synthetic construct
EVQLVESGGGIVQPGGSLKLSCAASGFTFNTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 826 - protein, 109 aa, synthetic construct; identical to SEQ ID NO: 101

SEQ ID NO: 827 - protein, 125 aa, synthetic construct
EVQLVESGGGIVQPGGSLKLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 828 - protein, 109 aa, synthetic construct; identical to SEQ ID NO: 101

SEQ ID NO: 829 - protein, 125 aa, synthetic construct; identical to SEQ ID NO: 102

SEQ ID NO: 830 - protein, 109 aa, synthetic construct; identical to SEQ ID NO: 101

SEQ ID NO: 831 - protein, 125 aa, synthetic construct
EVQLLESGGGIVQPGGSLKLSCAASGFTFNTYAMNWVRQAPGKGLEWVGRIRSKYNNGATYYADSVKGRFTISRDDSKNTVYLQMNSLKTEDTAVYYCVRHENFGNSYVSWFAHWGQGTLVTVSS

SEQ ID NO: 832 - protein, 109 aa, synthetic construct; identical to SEQ ID NO: 101

SEQ ID NO: 833 - protein, 125 aa, synthetic construct; identical to SEQ ID NO: 102

SEQ ID NO: 834 - protein, 109 aa, synthetic construct; identical to SEQ ID NO: 101

SEQ ID NO: 835 - protein, 125 aa, synthetic construct; identical to SEQ ID NO: 102

SEQ ID NO: 836 - protein, 109 aa, synthetic construct; identical to SEQ ID NO: 101

SEQ ID NO: 837 - protein, 125 aa, synthetic construct; identical to SEQ ID NO: 102

SEQ ID NO: 838 - protein, 109 aa, synthetic construct; identical to SEQ ID NO: 101

SEQ ID NO: 839 - protein, 125 aa, synthetic construct
EVQLLESGGGIVQPGGSLKLSCAASGFTFNTYAMNWVRQAPGKGLEDVARIRSKYNNYATYYADSVKDRFTISRDDSKNTVYLQMNNLKTEDTAVYYCVRHENFGNSYVSWFAHWGQGTLVTVSS

SEQ ID NO: 840 - protein, 109 aa, synthetic construct; identical to SEQ ID NO: 101

SEQ ID NO: 841 - protein, 125 aa, synthetic construct
EVQLLESGGGIVQPGGSLKLSCAASGFTFNTYAMNWVRQAPGKGLEEVARIRSKYNNYATYYADSVKDRFTISRDDSKNTVYLQMNNLKTEDTAVYYCVRHENFGNSYVSWFAHWGQGTLVTVSS

SEQ ID NO: 842 - protein, 109 aa, synthetic construct; identical to SEQ ID NO: 101

SEQ ID NO: 843 - protein, 125 aa, synthetic construct
EVQLLESGGGIVQPGGSLKLSCAASGFTFNTYAMNWVRQAPGKGLEWAARIRSKYNNYATYYADSVKDRFTISRDDSKNTVYLQMNNLKTEDTAVYYCVRHENFGNSYVSWFAHWGQGTLVTVSS

SEQ ID NO: 844 - protein, 109 aa, synthetic construct; identical to SEQ ID NO: 101

SEQ ID NO: 845 - protein, 125 aa, synthetic construct
EVQLLESGGGIVQPGGSLKLSCAASGFTFNTYAMNWVRQAPGKGLEWEARIRSKYNNYATYYADSVKDRFTISRDDSKNTVYLQMNNLKTEDTAVYYCVRHENFGNSYVSWFAHWGQGTLVTVSS

SEQ ID NO: 846 - protein, 109 aa, synthetic construct; identical to SEQ ID NO: 101

SEQ ID NO: 847 - protein, 125 aa, synthetic construct
EVQLLESGGGIVQPGGSLKLSCAASGFTFNTYAMNWVRQAPGKGLEWGARIRSKYNNYATYYADSVKDRFTISRDDSKNTVYLQMNNLKTEDTAVYYCVRHENFGNSYVSWFAHWGQGTLVTVSS

SEQ ID NO: 848 - protein, 109 aa, synthetic construct; identical to SEQ ID NO: 101

SEQ ID NO: 849 - protein, 125 aa, synthetic construct
EVQLLESGGGIVQPGGSLKLSCAASGFTFNTYAMNWVRQAPGKGLEWSARIRSKYNNYATYYADSVKDRFTISRDDSKNTVYLQMNNLKTEDTAVYYCVRHENFGNSYVSWFAHWGQGTLVTVSS

SEQ ID NO: 850 - protein, 109 aa, synthetic construct; identical to SEQ ID NO: 101

SEQ ID NO: 851 - protein, 125 aa, synthetic construct
EVQLLESGGGIVQPGGSLKLSCAASGFTFNTYAMNWVRQAPGKGLEWTARIRSKYNNYATYYADSVKDRFTISRDDSKNTVYLQMNNLKTEDTAVYYCVRHENFGNSYVSWFAHWGQGTLVTVSS

SEQ ID NO: 852 - protein, 109 aa, synthetic construct; identical to SEQ ID NO: 101

SEQ ID NO: 853 - protein, 125 aa, synthetic construct
EVQLLESGGGIVQPGGSLKLSCAASGFTFNTYAMNWVRQAPGKGLEWWARIRSKYNNYATYYADSVKDRFTISRDDSKNTVYLQMNNLKTEDTAVYYCVRHENFGNSYVSWFAHWGQGTLVTVSS

SEQ ID NO: 854 - protein, 109 aa, synthetic construct; identical to SEQ ID NO: 101

SEQ ID NO: 855 - protein, 125 aa, synthetic construct
EVQLLESGGGIVQPGGSLKLSCAASGFTFNTYAMNWVRQAPGKGLEWVDRIRSKYNNYATYYADSVKDRFTISRDDSKNTVYLQMNNLKTEDTAVYYCVRHENFGNSYVSWFAHWGQGTLVTVSS

SEQ ID NO: 856 - protein, 109 aa, synthetic construct; identical to SEQ ID NO: 101

SEQ ID NO: 857 - protein, 125 aa, synthetic construct
EVQLLESGGGIVQPGGSLKLSCAASGFTFNTYAMNWVRQAPGKGLEWVERIRSKYNNYATYYADSVKDRFTISRDDSKNTVYLQMNNLKTEDTAVYYCVRHENFGNSYVSWFAHWGQGTLVTVSS

SEQ ID NO: 858 - protein, 109 aa, synthetic construct; identical to SEQ ID NO: 101

SEQ ID NO: 859 - protein, 125 aa, synthetic construct
EVQLLESGGGIVQPGGSLKLSCAASGFTFNTYAMNWVRQAPGKGLEWVGRIRSKYNNYATYYADSVKDRFTISRDDSKNTVYLQMNNLKTEDTAVYYCVRHENFGNSYVSWFAHWGQGTLVTVSS

SEQ ID NO: 860 - protein, 109 aa, synthetic construct; identical to SEQ ID NO: 101

SEQ ID NO: 861 - protein, 125 aa, synthetic construct
EVQLLESGGGIVQPGGSLKLSCAASGFTFNTYAMNWVRQAPGKGLEWVAQIRSKYNNYATYYADSVKDRFTISRDDSKNTVYLQMNNLKTEDTAVYYCVRHENFGNSYVSWFAHWGQGTLVTVSS

SEQ ID NO: 862 - protein, 109 aa, synthetic construct; identical to SEQ ID NO: 101

SEQ ID NO: 863 - protein, 125 aa, synthetic construct
EVQLLESGGGIVQPGGSLKLSCAASGFTFNTYAMNWVRQAPGKGLEWVAGIRSKYNNYATYYADSVKDRFTISRDDSKNTVYLQMNNLKTEDTAVYYCVRHENFGNSYVSWFAHWGQGTLVTVSS

SEQ ID NO: 864 - protein, 109 aa, synthetic construct; identical to SEQ ID NO: 101

SEQ ID NO: 865 - protein, 125 aa, synthetic construct
EVQLLESGGGIVQPGGSLKLSCAASGFTFNTYAMNWVRQAPGKGLEWVAHIRSKYNNYATYYADSVKDRFTISRDDSKNTVYLQMNNLKTEDTAVYYCVRHENFGNSYVSWFAHWGQGTLVTVSS

SEQ ID NO: 866 - protein, 109 aa, synthetic construct; identical to SEQ ID NO: 101

SEQ ID NO: 867 - protein, 125 aa, synthetic construct
EVQLLESGGGIVQPGGSLKLSCAASGFTFNTYAMNWVRQAPGKGLEWVAPIRSKYNNYATYYADSVKDRFTISRDDSKNTVYLQMNNLKTEDTAVYYCVRHENFGNSYVSWFAHWGQGTLVTVSS

SEQ ID NO: 868 - protein, 109 aa, synthetic construct; identical to SEQ ID NO: 101

SEQ ID NO: 869 - protein, 125 aa, synthetic construct
EVQLLESGGGIVQPGGSLKLSCAASGFTFNTYAMNWVRQAPGKGLEWVAWIRSKYNNYATYYADSVKDRFTISRDDSKNTVYLQMNNLKTEDTAVYYCVRHENFGNSYVSWFAHWGQGTLVTVSS

SEQ ID NO: 870 - protein, 109 aa, synthetic construct; identical to SEQ ID NO: 101

SEQ ID NO: 871 - protein, 125 aa, synthetic construct
EVQLLESGGGIVQPGGSLKLSCAASGFTFNTYAMNWVRQAPGKGLEWVARARSKYNNYATYYADSVKDRFTISRDDSKNTVYLQMNNLKTEDTAVYYCVRHENFGNSYVSWFAHWGQGTLVTVSS

SEQ ID NO: 872 - protein, 109 aa, synthetic construct; identical to SEQ ID NO: 101

SEQ ID NO: 873 - protein, 125 aa, synthetic construct
EVQLLESGGGIVQPGGSLKLSCAASGFTFNTYAMNWVRQAPGKGLEWVARGRSKYNNYATYYADSVKDRFTISRDDSKNTVYLQMNNLKTEDTAVYYCVRHENFGNSYVSWFAHWGQGTLVTVSS

SEQ ID NO: 874 - protein, 109 aa, synthetic construct; identical to SEQ ID NO: 101

SEQ ID NO: 875 - protein, 125 aa, synthetic construct
EVQLLESGGGIVQPGGSLKLSCAASGFTFNTYAMNWVRQAPGKGLEWVARTRSKYNNYATYYADSVKDRFTISRDDSKNTVYLQMNNLKTEDTAVYYCVRHENFGNSYVSWFAHWGQGTLVTVSS

SEQ ID NO: 876 - protein, 109 aa, synthetic construct; identical to SEQ ID NO: 101

SEQ ID NO: 877 - protein, 125 aa, synthetic construct
EVQLLESGGGIVQPGGSLKLSCAASGFTFNTYAMNWVRQAPGKGLEWVARINSKYNNYATYYADSVKDRFTISRDDSKNTVYLQMNNLKTEDTAVYYCVRHENFGNSYVSWFAHWGQGTLVTVSS

SEQ ID NO: 878 - protein, 109 aa, synthetic construct; identical to SEQ ID NO: 101

SEQ ID NO: 879 - protein, 125 aa, synthetic construct
EVQLLESGGGIVQPGGSLKLSCAASGFTFNTYAMNWVRQAPGKGLEWVARIDSKYNNYATYYADSVKDRFTISRDDSKNTVYLQMNNLKTEDTAVYYCVRHENFGNSYVSWFAHWGQGTLVTVSS

SEQ ID NO: 880 - protein, 109 aa, synthetic construct; identical to SEQ ID NO: 101

SEQ ID NO: 881 - protein, 125 aa, synthetic construct
EVQLLESGGGIVQPGGSLKLSCAASGFTFNTYAMNWVRQAPGKGLEWVARIESKYNNYATYYADSVKDRFTISRDDSKNTVYLQMNNLKTEDTAVYYCVRHENFGNSYVSWFAHWGQGTLVTVSS

SEQ ID NO: 882 - protein, 109 aa, synthetic construct; identical to SEQ ID NO: 101

SEQ ID NO: 883 - protein, 125 aa, synthetic construct
EVQLLESGGGIVQPGGSLKLSCAASGFTFNTYAMNWVRQAPGKGLEWVARIQSKYNNYATYYADSVKDRFTISRDDSKNTVYLQMNNLKTEDTAVYYCVRHENFGNSYVSWFAHWGQGTLVTVSS

SEQ ID NO: 884 - protein, 109 aa, synthetic construct; identical to SEQ ID NO: 101

SEQ ID NO: 885 - protein, 125 aa, synthetic construct
EVQLLESGGGIVQPGGSLKLSCAASGFTFNTYAMNWVRQAPGKGLEWVARIGSKYNNYATYYADSVKDRFTISRDDSKNTVYLQMNNLKTEDTAVYYCVRHENFGNSYVSWFAHWGQGTLVTVSS

SEQ ID NO: 886 - protein, 109 aa, synthetic construct; identical to SEQ ID NO: 101

SEQ ID NO: 887 - protein, 125 aa, synthetic construct
EVQLLESGGGIVQPGGSLKLSCAASGFTFNTYAMNWVRQAPGKGLEWVARIHSKYNNYATYYADSVKDRFTISRDDSKNTVYLQMNNLKTEDTAVYYCVRHENFGNSYVSWFAHWGQGTLVTVSS

SEQ ID NO: 888 - protein, 109 aa, synthetic construct; identical to SEQ ID NO: 101

SEQ ID NO: 889 - protein, 125 aa, synthetic construct
EVQLLESGGGIVQPGGSLKLSCAASGFTFNTYAMNWVRQAPGKGLEWVARIWSKYNNYATYYADSVKDRFTISRDDSKNTVYLQMNNLKTEDTAVYYCVRHENFGNSYVSWFAHWGQGTLVTVSS

SEQ ID NO: 890 - protein, 109 aa, synthetic construct; identical to SEQ ID NO: 101

SEQ ID NO: 891 - protein, 125 aa, synthetic construct
EVQLLESGGGIVQPGGSLKLSCAASGFTFNTYAMNWVRQAPGKGLEWVARIRNKYNNYATYYADSVKDRFTISRDDSKNTVYLQMNNLKTEDTAVYYCVRHENFGNSYVSWFAHWGQGTLVTVSS

SEQ ID NO: 892 - protein, 109 aa, synthetic construct; identical to SEQ ID NO: 101

SEQ ID NO: 893 - protein, 125 aa, synthetic construct
EVQLLESGGGIVQPGGSLKLSCAASGFTFNTYAMNWVRQAPGKGLEWVARIRDKYNNYATYYADSVKDRFTISRDDSKNTVYLQMNNLKTEDTAVYYCVRHENFGNSYVSWFAHWGQGTLVTVSS

SEQ ID NO: 894 - protein, 109 aa, synthetic construct; identical to SEQ ID NO: 101

SEQ ID NO: 895 - protein, 125 aa, synthetic construct
EVQLLESGGGIVQPGGSLKLSCAASGFTFNTYAMNWVRQAPGKGLEWVARIREKYNNYATYYADSVKDRFTISRDDSKNTVYLQMNNLKTEDTAVYYCVRHENFGNSYVSWFAHWGQGTLVTVSS

SEQ ID NO: 896 - protein, 109 aa, synthetic construct; identical to SEQ ID NO: 101

SEQ ID NO: 897 - protein, 125 aa, synthetic construct
EVQLLESGGGIVQPGGSLKLSCAASGFTFNTYAMNWVRQAPGKGLEWVARIRTKYNNYATYYADSVKDRFTISRDDSKNTVYLQMNNLKTEDTAVYYCVRHENFGNSYVSWFAHWGQGTLVTVSS

SEQ ID NO: 898 - protein, 109 aa, synthetic construct; identical to SEQ ID NO: 101

SEQ ID NO: 899 - protein, 125 aa, synthetic construct
EVQLLESGGGIVQPGGSLKLSCAASGFTFNTYAMNWVRQAPGKGLEWVARIRSPYNNYATYYADSVKDRFTISRDDSKNTVYLQMNNLKTEDTAVYYCVRHENFGNSYVSWFAHWGQGTLVTVSS

SEQ ID NO: 900 - protein, 109 aa, synthetic construct; identical to SEQ ID NO: 101

SEQ ID NO: 901 - protein, 125 aa, synthetic construct
EVQLLESGGGIVQPGGSLKLSCAASGFTFNTYAMNWVRQAPGKGLEWVARIRSKANNYATYYADSVKDRFTISRDDSKNTVYLQMNNLKTEDTAVYYCVRHENFGNSYVSWFAHWGQGTLVTVSS

SEQ ID NO: 902 - protein, 109 aa, synthetic construct; identical to SEQ ID NO: 101

SEQ ID NO: 903 - protein, 125 aa, synthetic construct
EVQLLESGGGIVQPGGSLKLSCAASGFTFNTYAMNWVRQAPGKGLEWVARIRSKRNNYATYYADSVKDRFTISRDDSKNTVYLQMNNLKTEDTAVYYCVRHENFGNSYVSWFAHWGQGTLVTVSS

SEQ ID NO: 904 - protein, 109 aa, synthetic construct; identical to SEQ ID NO: 101

SEQ ID NO: 905 - protein, 125 aa, synthetic construct
EVQLLESGGGIVQPGGSLKLSCAASGFTFNTYAMNWVRQAPGKGLEWVARIRSKGNNYATYYADSVKDRFTISRDDSKNTVYLQMNNLKTEDTAVYYCVRHENFGNSYVSWFAHWGQGTLVTVSS

SEQ ID NO: 906 - protein, 109 aa, synthetic construct; identical to SEQ ID NO: 101

SEQ ID NO: 907 - protein, 125 aa, synthetic construct
EVQLLESGGGIVQPGGSLKLSCAASGFTFNTYAMNWVRQAPGKGLEWVARIRSKKNNYATYYADSVKDRFTISRDDSKNTVYLQMNNLKTEDTAVYYCVRHENFGNSYVSWFAHWGQGTLVTVSS

SEQ ID NO: 908 - protein, 109 aa, synthetic construct; identical to SEQ ID NO: 101

SEQ ID NO: 909 - protein, 125 aa, synthetic construct
EVQLLESGGGIVQPGGSLKLSCAASGFTFNTYAMNWVRQAPGKGLEWVARIRSKPNNYATYYADSVKDRFTISRDDSKNTVYLQMNNLKTEDTAVYYCVRHENFGNSYVSWFAHWGQGTLVTVSS

SEQ ID NO: 910 - protein, 109 aa, synthetic construct; identical to SEQ ID NO: 101

SEQ ID NO: 911 - protein, 125 aa, synthetic construct
EVQLLESGGGIVQPGGSLKLSCAASGFTFNTYAMNWVRQAPGKGLEWVARIRSKTNNYATYYADSVKDRFTISRDDSKNTVYLQMNNLKTEDTAVYYCVRHENFGNSYVSWFAHWGQGTLVTVSS

SEQ ID NO: 912 - protein, 109 aa, synthetic construct; identical to SEQ ID NO: 101

SEQ ID NO: 913 - protein, 125 aa, synthetic construct
EVQLLESGGGIVQPGGSLKLSCAASGFTFNTYAMNWVRQAPGKGLEWVARIRSKWNNYATYYADSVKDRFTISRDDSKNTVYLQMNNLKTEDTAVYYCVRHENFGNSYVSWFAHWGQGTLVTVSS

SEQ ID NO: 914 - protein, 109 aa, synthetic construct; identical to SEQ ID NO: 101

SEQ ID NO: 915 - protein, 125 aa, synthetic construct
EVQLLESGGGIVQPGGSLKLSCAASGFTFNTYAMNWVRQAPGKGLEWVARIRSKYDNYATYYADSVKDRFTISRDDSKNTVYLQMNNLKTEDTAVYYCVRHENFGNSYVSWFAHWGQGTLVTVSS

SEQ ID NO: 916 - protein, 109 aa, synthetic construct; identical to SEQ ID NO: 101

SEQ ID NO: 917 - protein, 125 aa, synthetic construct
EVQLLESGGGIVQPGGSLKLSCAASGFTFNTYAMNWVRQAPGKGLEWVARIRSKYENYATYYADSVKDRFTISRDDSKNTVYLQMNNLKTEDTAVYYCVRHENFGNSYVSWFAHWGQGTLVTVSS

SEQ ID NO: 918 - protein, 109 aa, synthetic construct; identical to SEQ ID NO: 101

SEQ ID NO: 919 - protein, 125 aa, synthetic construct
EVQLLESGGGIVQPGGSLKLSCAASGFTFNTYAMNWVRQAPGKGLEWVARIRSKYNDYATYYADSVKDRFTISRDDSKNTVYLQMNNLKTEDTAVYYCVRHENFGNSYVSWFAHWGQGTLVTVSS

SEQ ID NO: 920 - protein, 109 aa, synthetic construct; identical to SEQ ID NO: 101

SEQ ID NO: 921 - protein, 125 aa, synthetic construct
EVQLLESGGGIVQPGGSLKLSCAASGFTFNTYAMNWVRQAPGKGLEWVARIRSKYNEYATYYADSVKDRFTISRDDSKNTVYLQMNNLKTEDTAVYYCVRHENFGNSYVSWFAHWGQGTLVTVSS

SEQ ID NO: 922 - protein, 109 aa, synthetic construct; identical to SEQ ID NO: 101

SEQ ID NO: 923 - protein, 125 aa, synthetic construct
EVQLLESGGGIVQPGGSLKLSCAASGFTFNTYAMNWVRQAPGKGLEWVARIRSKYNNGATYYADSVKDRFTISRDDSKNTVYLQMNNLKTEDTAVYYCVRHENFGNSYVSWFAHWGQGTLVTVSS

SEQ ID NO: 924 - protein, 109 aa, synthetic construct; identical to SEQ ID NO: 101

SEQ ID NO: 925 - protein, 125 aa, synthetic construct
EVQLLESGGGIVQPGGSLKLSCAASGFTFNTYAMNWVRQAPGKGLEWVARIRSKYNNFATYYADSVKDRFTISRDDSKNTVYLQMNNLKTEDTAVYYCVRHENFGNSYVSWFAHWGQGTLVTVSS

SEQ ID NO: 926 - protein, 109 aa, synthetic construct; identical to SEQ ID NO: 101

SEQ ID NO: 927 - protein, 125 aa, synthetic construct
EVQLLESGGGIVQPGGSLKLSCAASGFTFNTYAMNWVRQAPGKGLEWVARIRSKYNNWATYYADSVKDRFTISRDDSKNTVYLQMNNLKTEDTAVYYCVRHENFGNSYVSWFAHWGQGTLVTVSS

SEQ ID NO: 928 - protein, 109 aa, synthetic construct; identical to SEQ ID NO: 101

SEQ ID NO: 929 - protein, 125 aa, synthetic construct
EVQLLESGGGIVQPGGSLKLSCAASGFTFNTYAMNWVRQAPGKGLEWVARIRSKYNNYGTYYADSVKDRFTISRDDSKNTVYLQMNNLKTEDTAVYYCVRHENFGNSYVSWFAHWGQGTLVTVSS

SEQ ID NO: 930 - protein, 109 aa, synthetic construct; identical to SEQ ID NO: 101

SEQ ID NO: 931 - protein, 125 aa, synthetic construct
EVQLLESGGGIVQPGGSLKLSCAASGFTFNTYAMNWVRQAPGKGLEWVARIRSKYNNYTTYYADSVKDRFTISRDDSKNTVYLQMNNLKTEDTAVYYCVRHENFGNSYVSWFAHWGQGTLVTVSS

SEQ ID NO: 932 - protein, 109 aa, synthetic construct; identical to SEQ ID NO: 101

SEQ ID NO: 933 - protein, 125 aa, synthetic construct
EVQLLESGGGIVQPGGSLKLSCAASGFTFNTYAMNWVRQAPGKGLEWVARIRSKYNNYATDYADSVKDRFTISRDDSKNTVYLQMNNLKTEDTAVYYCVRHENFGNSYVSWFAHWGQGTLVTVSS

SEQ ID NO: 934 - protein, 109 aa, synthetic construct; identical to SEQ ID NO: 101

SEQ ID NO: 935 - protein, 125 aa, synthetic construct
EVQLLESGGGIVQPGGSLKLSCAASGFTFNTYAMNWVRQAPGKGLEWVARIRSKYNNYATEYADSVKDRFTISRDDSKNTVYLQMNNLKTEDTAVYYCVRHENFGNSYVSWFAHWGQGTLVTVSS

SEQ ID NO: 936 - protein, 109 aa, synthetic construct; identical to SEQ ID NO: 101

SEQ ID NO: 937 - protein, 125 aa, synthetic construct
EVQLLESGGGIVQPGGSLKLSCAASGFTFNTYAMNWVRQAPGKGLEWVARIRSKYNNYATTYADSVKDRFTISRDDSKNTVYLQMNNLKTEDTAVYYCVRHENFGNSYVSWFAHWGQGTLVTVSS

SEQ ID NO: 938 - protein, 109 aa, synthetic construct; identical to SEQ ID NO: 101

SEQ ID NO: 939 - protein, 125 aa, synthetic construct
EVQLLESGGGIVQPGGSLKLSCAASGFTFNTYAMNWVRQAPGKGLEWVARIRSKYNNYATYDADSVKDRFTISRDDSKNTVYLQMNNLKTEDTAVYYCVRHENFGNSYVSWFAHWGQGTLVTVSS

SEQ ID NO: 940 - protein, 109 aa, synthetic construct; identical to SEQ ID NO: 101

SEQ ID NO: 941 - protein, 125 aa, synthetic construct
EVQLLESGGGIVQPGGSLKLSCAASGFTFNTYAMNWVRQAPGKGLEWVARIRSKYNNYATYEADSVKDRFTISRDDSKNTVYLQMNNLKTEDTAVYYCVRHENFGNSYVSWFAHWGQGTLVTVSS

SEQ ID NO: 942 - protein, 109 aa, synthetic construct; identical to SEQ ID NO: 101

SEQ ID NO: 943 - protein, 125 aa, synthetic construct
EVQLLESGGGIVQPGGSLKLSCAASGFTFNTYAMNWVRQAPGKGLEWVARIRSKYNNYATYQADSVKDRFTISRDDSKNTVYLQMNNLKTEDTAVYYCVRHENFGNSYVSWFAHWGQGTLVTVSS

SEQ ID NO: 944 - protein, 109 aa, synthetic construct; identical to SEQ ID NO: 101

SEQ ID NO: 945 - protein, 125 aa, synthetic construct
EVQLLESGGGIVQPGGSLKLSCAASGFTFNTYAMNWVRQAPGKGLEWVARIRSKYNNYATYGADSVKDRFTISRDDSKNTVYLQMNNLKTEDTAVYYCVRHENFGNSYVSWFAHWGQGTLVTVSS

SEQ ID NO: 946 - protein, 109 aa, synthetic construct; identical to SEQ ID NO: 101

SEQ ID NO: 947 - protein, 125 aa, synthetic construct
EVQLLESGGGIVQPGGSLKLSCAASGFTFNTYAMNWVRQAPGKGLEWVARIRSKYNNYATYWADSVKDRFTISRDDSKNTVYLQMNNLKTEDTAVYYCVRHENFGNSYVSWFAHWGQGTLVTVSS

SEQ ID NO: 948 - protein, 109 aa, synthetic construct; identical to SEQ ID NO: 101

SEQ ID NO: 949 - protein, 125 aa, synthetic construct
EVQLLESGGGIVQPGGSLKLSCAASGFTFNTYAMNWVRQAPGKGLEWVARIRSKYNNYATYYKDSVKDRFTISRDDSKNTVYLQMNNLKTEDTAVYYCVRHENFGNSYVSWFAHWGQGTLVTVSS

SEQ ID NO: 950 - protein, 109 aa, synthetic construct; identical to SEQ ID NO: 101

SEQ ID NO: 951 - protein, 125 aa, synthetic construct
EVQLLESGGGIVQPGGSLKLSCAASGFTFNTYAMNWVRQAPGKGLEWVARIRSKYNNYATYYPDSVKDRFTISRDDSKNTVYLQMNNLKTEDTAVYYCVRHENFGNSYVSWFAHWGQGTLVTVSS

SEQ ID NO: 952 - protein, 109 aa, synthetic construct; identical to SEQ ID NO: 101

SEQ ID NO: 953 - protein, 125 aa, synthetic construct
EVQLLESGGGIVQPGGSLKLSCAASGFTFNTYAMNWVRQAPGKGLEWVARIRSKYNNYATYYADSVKGRFTISRDDSKNTVYLQMNNLKTEDTAVYYCVRHENFGNSYVSWFAHWGQGTLVTVSS

SEQ ID NO: 954 - protein, 109 aa, synthetic construct; identical to SEQ ID NO: 101

SEQ ID NO: 955 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVDLQMNNLKTEDTAVYYCVRHENFGNSYVSWFAHWGQGTLVTVSS

SEQ ID NO: 956 - protein, 109 aa, synthetic construct; identical to SEQ ID NO: 101

SEQ ID NO: 957 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVGLQMNNLKTEDTAVYYCVRHENFGNSYVSWFAHWGQGTLVTVSS

SEQ ID NO: 958 - protein, 109 aa, synthetic construct; identical to SEQ ID NO: 101

SEQ ID NO: 959 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVSLQMNNLKTEDTAVYYCVRHENFGNSYVSWFAHWGQGTLVTVSS

SEQ ID NO: 960 - protein, 109 aa, synthetic construct; identical to SEQ ID NO: 101

SEQ ID NO: 961 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNELKTEDTAVYYCVRHENFGNSYVSWFAHWGQGTLVTVSS

SEQ ID NO: 962 - protein, 109 aa, synthetic construct; identical to SEQ ID NO: 101

SEQ ID NO: 963 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNQLKTEDTAVYYCVRHENFGNSYVSWFAHWGQGTLVTVSS

SEQ ID NO: 964 - protein, 109 aa, synthetic construct; identical to SEQ ID NO: 101

SEQ ID NO: 965 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNSLKTEDTAVYYCVRHENFGNSYVSWFAHWGQGTLVTVSS

SEQ ID NO: 966 - protein, 109 aa, synthetic construct; identical to SEQ ID NO: 101

SEQ ID NO: 967 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNYLKTEDTAVYYCVRHENFGNSYVSWFAHWGQGTLVTVSS

SEQ ID NO: 968 - protein, 109 aa, synthetic construct; identical to SEQ ID NO: 101

SEQ ID NO: 969 - protein, 125 aa, synthetic construct; identical to SEQ ID NO: 831

SEQ ID NO: 970 - protein, 109 aa, synthetic construct
ELVVTQEPSLTVSPGGTVTLTCRSSNGAVTSSNYANWVQQKPGQAPRGLIGGTNKRAPGTPARFSGSLQGGKAALTLSGVQPEDEAVYYCALWYPNLWVFGGGTKLTVL

SEQ ID NO: 971 - protein, 125 aa, synthetic construct; identical to SEQ ID NO: 102

SEQ ID NO: 972 - protein, 109 aa, synthetic construct
ELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVL

SEQ ID NO: 973 - protein, 125 aa, synthetic construct; identical to SEQ ID NO: 102

SEQ ID NO: 974 - protein, 109 aa, synthetic construct
ELVVTQEPSLTVSPGGTVTLTCRSSNGAVTSSNYANWVQQKPGQAPRGLIGGTNKRAPGTPARFSGSLDGGKAALTLSGVQPEDEAVYYCALWYPNLWVFGGGTKLTVL

SEQ ID NO: 975 - protein, 125 aa, synthetic construct; identical to SEQ ID NO: 102

SEQ ID NO: 976 - protein, 109 aa, synthetic construct; identical to SEQ ID NO: 104

SEQ ID NO: 977 - protein, 125 aa, synthetic construct; identical to SEQ ID NO: 102

SEQ ID NO: 978 - protein, 109 aa, synthetic construct
ELVVTQEPSLTVSPGGTVTLTCRSSNGAVTSSNYANWVQQKPGQAPRGLIGGTNKRAPGTPARFSGSKLGGKAALTLSGVQPEDEAVYYCALWYPNLWVFGGGTKLTVL

SEQ ID NO: 979 - protein, 125 aa, synthetic construct; identical to SEQ ID NO: 102

SEQ ID NO: 980 - protein, 109 aa, synthetic construct
ELVVTQEPSLTVSPGGTVTLTCRSSNGAVTSSNYANWVQQKPGQAPRGLIGGTNKRAPGTPARFSGSNLGGKAALTLSGVQPEDEAVYYCALWYPNLWVFGGGTKLTVL

SEQ ID NO: 981 - protein, 125 aa, synthetic construct; identical to SEQ ID NO: 102

SEQ ID NO: 982 - protein, 109 aa, synthetic construct
ELVVTQEPSLTVSPGGTVTLTCRSSNGAVTSSNYANWVQQKPGQAPRGLIGGTNKRAPGTPARFSGSTLGGKAALTLSGVQPEDEAVYYCALWYPNLWVFGGGTKLTVL

SEQ ID NO: 983 - protein, 125 aa, synthetic construct; identical to SEQ ID NO: 102

SEQ ID NO: 984-999 - skipped (16 entries)

SEQ ID NO: 1000 - protein, 1327 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESQVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1001 - protein, 1327 aa, synthetic construct
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTQVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRLYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 1002 - protein, 1333 aa, synthetic construct
ASHHHHHHSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSANHTPAGLTGPGTSESATPESQVQLVESGGGVVQPGRSLRLSCAASGRTFGIYVMGWVRQAPGKEREFVAAISWSGSNRKVSDSVKGRFTISRDNSKNTLYLQMNSLRAEDTAVYYCAASNRLYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLSESATPESGPGTSPGATPESGPGTSESATPEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTATPESGPGEAGRSANHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1003 - protein, 1327 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESQVQLVESGGGVVQPGRSLRLSCAASGRTFGIYVWGWFRQAPGKEREFVGAMSWSGSNRKVSDSVKGRFTISRDNSKNTLYLQMNSLRAEDTAVYYCAASNKEYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLSESATPESGPGTSPGATPESGPGTSESATPEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1004 - protein, 1327 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESQVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNKLYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1005 - protein, 1335 aa, synthetic construct
ASHHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTEVQLVESGGGSVQAGGSLSLSCVASGRTFGIYVMGWFRQAPGKEREFVAAISWSGSNRLVSDSVKGRFTISRENAKNTIYLQMNGLKPEDTANYFCAASNRLYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 1006 - protein, 747 aa, synthetic construct
ASHHHHHHATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTQVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRLYGRTWYDFNESDYWGQGTQVTVSSGGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 1007 - protein, 757 aa, synthetic construct
ASHHHHHHATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTQVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRLYGRTWYDFNESDYWGQGTQVTVSSGATPPETGAETESPGELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 1008 - protein, 751 aa, synthetic construct
ASHHHHHHATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTQVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRLYGRTWYDFNESDYWGQGTQVTVSSGGGGSGGGSEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGATPPETGAETESPGETTGGSAESEPPGEGELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGTAEAASASGEAGRSANHTPAGLTGPESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 1009 - protein, 761 aa, synthetic construct
ASHHHHHHATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPRAPPEPEFARATSGSETPGTQVQLVESGGGVVQPGRSLRLSCAASGRTFGIYVMGWVRQAPGKEREFVAAISWSGSNRKVSDSVKGRFTISRDNSKNTLYLQMNSLRAEDTAVYYCAASNRLYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAGLTGPESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 1010 - protein, 12 aa, synthetic construct
SGPGTGTSATPE

SEQ ID NO: 1011 - protein, 12 aa, synthetic construct
SGPGTTPGTTPE

SEQ ID NO: 1012 - protein, 12 aa, synthetic construct
SGPGTPPTSTPE

SEQ ID NO: 1013 - protein, 12 aa, synthetic construct
SGPGTGSAGTPE

SEQ ID NO: 1014 - protein, 12 aa, synthetic construct
SGPGTGGAGTPE

SEQ ID NO: 1015 - protein, 12 aa, synthetic construct
SGPGTSPGATPE

SEQ ID NO: 1016 - protein, 12 aa, synthetic construct
SGPGTSGSGTPE

SEQ ID NO: 1017 - protein, 12 aa, synthetic construct
SGPGTSSASTPE

SEQ ID NO: 1018 - protein, 12 aa, synthetic construct
SGPGTGAGTTPE

SEQ ID NO: 1019 - protein, 12 aa, synthetic construct
SGPGTGSTSTPE

SEQ ID NO: 1020 - protein, 12 aa, synthetic construct
TPGSEPATSGSE

SEQ ID NO: 1021 - protein, 12 aa, synthetic construct
GSAPGTSTEPSE

SEQ ID NO: 1022 - protein, 12 aa, synthetic construct
SGPGTAGSGTPE

SEQ ID NO: 1023 - protein, 12 aa, synthetic construct
SGPGTSSGGTPE

SEQ ID NO: 1024 - protein, 12 aa, synthetic construct
SGPGTAGPATPE

SEQ ID NO: 1025 - protein, 12 aa, synthetic construct
SGPGTPGTGTPE

SEQ ID NO: 1026 - protein, 12 aa, synthetic construct
SGPGTGGPTTPE

SEQ ID NO: 1027 - protein, 12 aa, synthetic construct
SGPGTGSGSTPE

SEQ ID NO: 1028 - protein, 713 aa, synthetic construct
HHHHHHKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 1029 - protein, 138 aa, synthetic construct
QVQLVESGGGLVQAGGSLRLSCAASGRTVNSYAMGWFRQAPGKEREFVASQSWMGAITYDADYADSVKGRFTISRDNAKNTLYLQMNSLKPEDTAVYRCAASRQARPGLHVREYDVWGQGTQVTVSSGPGGQHHHHHH

SEQ ID NO: 1030 - protein, 133 aa, synthetic construct
EVQLVESGGGLVQPGGSLRLSCVASVSSFSTNDMGWYRQAPGKQRELVAGITVGGNTFYAGSVKGRFTISRDNGKNTMYLQMNSLKPEDTAVYFCNVGAKYRKPEWYSGEYWGQGTQVTVSSGPGGQHHHHHH

SEQ ID NO: 1031 - protein, 125 aa, synthetic construct
EVQLVESGGGLVQAGGSLRLSCVVSGIAFSPYHMAWYRQAPGKQHEWVAVITTGGTTAYNETVEGRFSISRDNARSTVYLQMNSLKPEDTAVYYCNIYGLSLKWGQGTQVTVSSGPGGQHHHHHH

SEQ ID NO: 1032 - protein, 134 aa, synthetic construct
EVQLVESGGGLVQAGGSLKLSCVANGPTFSTYAMAWFRQAPGKEHEFVAAITGDGDTTNNADSVKGRFTISRDNAKNRVYLQLNSLKPEDTAAYYCAAGVHHTYTIPRLWLYWGQGTQVTVSSGPGGQHHHHHH

SEQ ID NO: 1033 - protein, 135 aa, synthetic construct
EVQLVESGGGLVQAGGSLRISCTASERSVSTYTKGWFRQAPGKERHLVAAISYNGDTTYYSDSVKGRFTISRDNVKNTVNLQMNSLKPEDTAVYFCAARGSSWLYGTWDDYHYWGQGTQVTVSSGPGGQHHHHHH

SEQ ID NO: 1034 - protein, 137 aa, synthetic construct
QVQLVESGGGLVQAGDSLRLSCVTSGRTFDVYAMGWFRQAPGKERELVAAINWSGSNKFHADSVKGRFTISRDNAWKTLSLQMNSLKPEDTAVYFCAASTRLYGTTWYEFNDSDYWGQGTQVTVSSGPGGQHHHHHH

SEQ ID NO: 1035 - protein, 137 aa, synthetic construct
EVQLVESGGGSVQAGGSLSLSCVASGRTFGIYVMGWFRQAPGKEREFVAAISWSGSNRLVSDSVKGRFTISRENAKNTIYLQMNGLKPEDTANYFCAASNRLYGRTWYDFNESDYWGQGTQVTVSSGPGGQHHHHHH

SEQ ID NO: 1036 - protein, 433 aa, synthetic construct
LTGPATSGSETPGTEVQLVESGGGLVQAGGSLRISCTASERSVSTYTKGWFRQAPGKERHLVAAISYNGDTTYYSDSVKGRFTISRDNVKNTVNLQMNSLKPEDTAVYFCAARGSSWLYGTWDDYHYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1037 - protein, 436 aa, synthetic construct
LTGPATSGSETPGTQVQLVESGGGLVQAGGSLRLSCAASGRTVNSYAMGWFRQAPGKEREFVASQSWMGAITYDADYADSVKGRFTISRDNAKNTLYLQMNSLKPEDTAVYRCAASRQARPGLHVREYDVWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1038 - protein, 435 aa, synthetic construct
LTGPATSGSETPGTEVQLVESGGGSVQAGGSLSLSCVASGRTFGIYVMGWFRQAPGKEREFVAAISWSGSNRLVSDSVKGRFTISRENAKNTIYLQMNGLKPEDTANYFCAASNRLYGRTWYDFNESDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1039 - protein, 435 aa, synthetic construct
LTGPATSGSETPGTQVQLVESGGGLVQAGDSLRLSCVTSGRTFDVYAMGWFRQAPGKERELVAAINWSGSNKFHADSVKGRFTISRDNAWKTLSLQMNSLKPEDTAVYFCAASTRLYGTTWYEFNDSDYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1040 - protein, 431 aa, synthetic construct
LTGPATSGSETPGTEVQLVESGGGLVQPGGSLRLSCVASVSSFSTNDMGWYRQAPGKQRELVAGITVGGNTFYAGSVKGRFTISRDNGKNTMYLQMNSLKPEDTAVYFCNVGAKYRKPEWYSGEYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1041 - protein, 432 aa, synthetic construct
LTGPATSGSETPGTEVQLVESGGGLVQAGGSLKLSCVANGPTFSTYAMAWFRQAPGKEHEFVAAITGDGDTTNNADSVKGRFTISRDNAKNRVYLQLNSLKPEDTAAYYCAAGVHHTYTIPRLWLYWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1042 - protein, 423 aa, synthetic construct
LTGPATSGSETPGTEVQLVESGGGLVQAGGSLRLSCVVSGIAFSPYHMAWYRQAPGKQHEWVAVITTGGTTAYNETVEGRFSISRDNARSTVYLQMNSLKPEDTAVYYCNIYGLSLKWGQGTQVTVSSGGGGSGGGSELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSSGTAEAASASGEAGRSANHTPAG

SEQ ID NO: 1043 - protein, 104 aa, synthetic construct
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 1044 - protein, 707 aa, synthetic construct
KSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 1045-1714 - skipped (670 entries)

SEQ ID NO: 1715 - protein, 12 aa, synthetic construct
GSGASEPTSTEP

SEQ ID NO: 1716 - protein, 12 aa, synthetic construct
GSEPATSGTEPS

SEQ ID NO: 1717 - protein, 12 aa, synthetic construct
GTSEPSTSEPGA

SEQ ID NO: 1718 - protein, 12 aa, synthetic construct
GTSTEPSEPGSA

SEQ ID NO: 1719 - protein, 12 aa, synthetic construct
GSTAGSETSTEA

SEQ ID NO: 1720 - protein, 12 aa, synthetic construct
GSETATSGSETA

SEQ ID NO: 1721 - protein, 12 aa, synthetic construct
GTSESATSESGA

SEQ ID NO: 1722 - protein, 12 aa, synthetic construct
GTSTEASEGSAS

SEQ ID NO: 1723-7000 - skipped (5278 entries)

SEQ ID NO: 7001 - protein, 16 aa, synthetic construct
EAGRSANHEPLGLVAT

SEQ ID NO: 7002 - protein, 16 aa, synthetic construct
ASGRSTNAGPSGLAGP

SEQ ID NO: 7003 - protein, 16 aa, synthetic construct
ASGRSTNAGPQGLAGQ

SEQ ID NO: 7004 - protein, 16 aa, synthetic construct
ASGRSTNAGPPGLTGP

SEQ ID NO: 7005 - protein, 16 aa, synthetic construct
ASSRGTNAGPAGLTGP

SEQ ID NO: 7006 - protein, 16 aa, synthetic construct
ASSRTTNTGPSTLTGP

SEQ ID NO: 7007 - protein, 16 aa, synthetic construct
AAGRSDNGTPLELVAP

SEQ ID NO: 7008 - protein, 16 aa, synthetic construct
EAGRSANHEPLGLVAT

SEQ ID NO: 7009 - protein, 16 aa, synthetic construct
ASGRGTNAGPAGLTGP

SEQ ID NO: 7010 - protein, 16 aa, synthetic construct
LFGRNDNHEPLELGGG

SEQ ID NO: 7011 - protein, 16 aa, synthetic construct
TAGRSDNLEPLGLVFG

SEQ ID NO: 7012 - protein, 16 aa, synthetic construct
LDGRSDNFHPPELVAG

SEQ ID NO: 7013 - protein, 16 aa, synthetic construct
LEGRSDNEEPENLVAG

SEQ ID NO: 7014 - protein, 16 aa, synthetic construct
LKGRSDNNAPLALVAG

SEQ ID NO: 7015 - protein, 16 aa, synthetic construct
VYSRGTNAGPHGLTGR

SEQ ID NO: 7016 - protein, 16 aa, synthetic construct
ANSRGTNKGFAGLIGP

SEQ ID NO: 7017 - protein, 16 aa, synthetic construct
ASSRLTNEAPAGLTIP

SEQ ID NO: 7018 - protein, 16 aa, synthetic construct
DQSRGTNAGPEGLTDP

SEQ ID NO: 7019 - protein, 16 aa, synthetic construct
ESSRGTNIGQGGLTGP

SEQ ID NO: 7020 - protein, 16 aa, synthetic construct
SSSRGTNQDPAGLTIP

SEQ ID NO: 7021 - protein, 16 aa, synthetic construct
ASSRGQNHSPMGLTGP

SEQ ID NO: 7022 - protein, 16 aa, synthetic construct
AYSRGPNAGPAGLEGR

SEQ ID NO: 7023 - protein, 16 aa, synthetic construct
ASERGNNAGPANLTGF

SEQ ID NO: 7024 - protein, 16 aa, synthetic construct
ASHRGTNPKPAILTGP

SEQ ID NO: 7025 - protein, 16 aa, synthetic construct
MSSRRTNANPAQLTGP

SEQ ID NO: 7026 - protein, 16 aa, synthetic construct
GAGRTDNHEPLELGAA

SEQ ID NO: 7027 - protein, 16 aa, synthetic construct
LAGRSENTAPLELTAG

SEQ ID NO: 7028 - protein, 16 aa, synthetic construct
LEGRPDNHEPLALVAS

SEQ ID NO: 7029 - protein, 16 aa, synthetic construct
LSGRSDNEEPLALPAG

SEQ ID NO: 7030 - protein, 16 aa, synthetic construct
EAGRTDNHEPLELSAP

SEQ ID NO: 7031 - protein, 16 aa, synthetic construct
EGGRSDNHGPLELVSG

SEQ ID NO: 7032 - protein, 16 aa, synthetic construct
LSGRSDNEAPLELEAG

SEQ ID NO: 7033 - protein, 16 aa, synthetic construct
LGGRADNHEPPELGAG

SEQ ID NO: 7034 - protein, 16 aa, synthetic construct
PPSRGTNAEPAGLTGE

SEQ ID NO: 7035 - protein, 16 aa, synthetic construct
ASTRGENAGPAGLEAP

SEQ ID NO: 7036 - protein, 16 aa, synthetic construct
ESSRGTNGAPEGLTGP

SEQ ID NO: 7037 - protein, 16 aa, synthetic construct
ASSRATNESPAGLTGE

SEQ ID NO: 7038 - protein, 16 aa, synthetic construct
ASSRGENPPPGGLTGP

SEQ ID NO: 7039 - protein, 16 aa, synthetic construct
AASRGTNTGPAELTGS

SEQ ID NO: 7040 - protein, 16 aa, synthetic construct
AGSRTTNAGPGGLEGP

SEQ ID NO: 7041 - protein, 16 aa, synthetic construct
APSRGENAGPATLTGA

SEQ ID NO: 7042 - protein, 16 aa, synthetic construct
ESGRAANTGPPTLTAP

SEQ ID NO: 7043 - protein, 16 aa, synthetic construct
NPGRAANEGPPGLPGS

SEQ ID NO: 7044 - protein, 16 aa, synthetic construct
ESSRAANLTPPELTGP

SEQ ID NO: 7045 - protein, 16 aa, synthetic construct
ASGRAANETPPGLTGA

SEQ ID NO: 7046 - protein, 16 aa, synthetic construct
NSGRGENLGAPGLTGT

SEQ ID NO: 7047 - protein, 16 aa, synthetic construct
TTGRAANLTPAGLTGP

SEQ ID NO: 7048 - protein, 16 aa, synthetic construct
EAGRSANHTPAGLTGP

SEQ ID NO: 7049 - protein, 16 aa, synthetic construct
ESGRAANTTPAGLTGP

SEQ ID NO: 7050 - protein, 19 aa, synthetic construct
TTGRATEAANLTPAGLTGP

SEQ ID NO: 7051 - protein, 19 aa, synthetic construct
TTGRAEEAANLTPAGLTGP

SEQ ID NO: 7052 - protein, 19 aa, synthetic construct
TTGRAGEAANLTPAGLTGP

SEQ ID NO: 7053 - protein, 19 aa, synthetic construct
TTGRATEAANATPAGLTGP

SEQ ID NO: 7054 - protein, 19 aa, synthetic construct
TTGRAGEAEGATSAGATGP

SEQ ID NO: 7055 - protein, 19 aa, synthetic construct
TTGEAGEAANATSAGATGP

SEQ ID NO: 7056 - protein, 19 aa, synthetic construct
TTGEAGEAAGLTPAGLTGP

SEQ ID NO: 7057 - protein, 19 aa, synthetic construct
TTGAAGEAANATPAGLTGP

SEQ ID NO: 7058 - protein, 19 aa, synthetic construct
TTGRAGEAAGLTPAGLTGP

SEQ ID NO: 7059 - protein, 19 aa, synthetic construct
TTGRAGEAANATSAGATGP

SEQ ID NO: 7060 - protein, 19 aa, synthetic construct
TTGEAGEAAGATSAGATGP

SEQ ID NO: 7061 - protein, 16 aa, synthetic construct
ESGRAANTEPPELGAG

SEQ ID NO: 7062 - protein, 16 aa, synthetic construct
ESGRAANTAPEGLTGP

SEQ ID NO: 7063 - protein, 16 aa, synthetic construct
EPGRAANHEPSGLTEG

SEQ ID NO: 7064 - protein, 19 aa, synthetic construct
ESGRAANHTGAPPGGLTGP

SEQ ID NO: 7065 - protein, 19 aa, synthetic construct
TTGRTGEGANATPGGLTGP

SEQ ID NO: 7066 - protein, 19 aa, synthetic construct
RTGRSGEAANETPEGLEGP

SEQ ID NO: 7067 - protein, 19 aa, synthetic construct
RTGRTGESANETPAGLGGP

SEQ ID NO: 7068 - protein, 19 aa, synthetic construct
STGRTGEPANETPAGLSGP

SEQ ID NO: 7069 - protein, 19 aa, synthetic construct
TTGRAGEPANATPTGLSGP

SEQ ID NO: 7070 - protein, 19 aa, synthetic construct
RTGRPGEGANATPTGLPGP

SEQ ID NO: 7071 - protein, 19 aa, synthetic construct
RTGRGGEAANATPSGLGGP

SEQ ID NO: 7072 - protein, 19 aa, synthetic construct
STGRSGESANATPGGLGGP

SEQ ID NO: 7073 - protein, 19 aa, synthetic construct
RTGRTGEEANATPAGLPGP

SEQ ID NO: 7074 - protein, 19 aa, synthetic construct
ATGRPGEPANTTPEGLEGP

SEQ ID NO: 7075 - protein, 19 aa, synthetic construct
STGRSGEPANATPGGLTGP

SEQ ID NO: 7076 - protein, 19 aa, synthetic construct
PTGRGGEGANTTPTGLPGP

SEQ ID NO: 7077 - protein, 19 aa, synthetic construct
PTGRSGEGANATPSGLTGP

SEQ ID NO: 7078 - protein, 19 aa, synthetic construct
TTGRASEGANSTPAPLTEP

SEQ ID NO: 7079 - protein, 19 aa, synthetic construct
TYGRAAEAANTTPAGLTAP

SEQ ID NO: 7080 - protein, 19 aa, synthetic construct
TTGRATEGANATPAELTEP

SEQ ID NO: 7081 - protein, 19 aa, synthetic construct
TVGRASEEANTTPASLTGP

SEQ ID NO: 7082 - protein, 19 aa, synthetic construct
TTGRAPEAANATPAPLTGP

SEQ ID NO: 7083 - protein, 19 aa, synthetic construct
TWGRATEPANATPAPLTSP

SEQ ID NO: 7084 - protein, 19 aa, synthetic construct
TVGRASESANATPAELTSP

SEQ ID NO: 7085 - protein, 19 aa, synthetic construct
TVGRAPEGANSTPAGLTGP

SEQ ID NO: 7086 - protein, 19 aa, synthetic construct
TWGRATEAPNLEPATLTTP

SEQ ID NO: 7087 - protein, 19 aa, synthetic construct
TTGRATEAPNLTPAPLTEP

SEQ ID NO: 7088 - protein, 19 aa, synthetic construct
TQGRATEAPNLSPAALTSP

SEQ ID NO: 7089 - protein, 19 aa, synthetic construct
TQGRAAEAPNLTPATLTAP

SEQ ID NO: 7090 - protein, 19 aa, synthetic construct
TSGRAPEATNLAPAPLTGP

SEQ ID NO: 7091 - protein, 19 aa, synthetic construct
TQGRAAEAANLTPAGLTEP

SEQ ID NO: 7092 - protein, 19 aa, synthetic construct
TTGRAGSAPNLPPTGLTTP

SEQ ID NO: 7093 - protein, 19 aa, synthetic construct
TTGRAGGAENLPPEGLTAP

SEQ ID NO: 7094 - protein, 19 aa, synthetic construct
TTSRAGTATNLTPEGLTAP

SEQ ID NO: 7095 - protein, 19 aa, synthetic construct
TTGRAGTATNLPPSGLTTP

SEQ ID NO: 7096 - protein, 19 aa, synthetic construct
TTARAGEAENLSPSGLTAP

SEQ ID NO: 7097 - protein, 19 aa, synthetic construct
TTGRAGGAGNLAPGGLTEP

SEQ ID NO: 7098 - protein, 19 aa, synthetic construct
TTGRAGTATNLPPEGLTGP

SEQ ID NO: 7099 - protein, 19 aa, synthetic construct
TTGRAGGAANLAPTGLTEP

SEQ ID NO: 7100 - protein, 19 aa, synthetic construct
TTGRAGTAENLAPSGLTTP

SEQ ID NO: 7101 - protein, 19 aa, synthetic construct
TTGRAGSATNLGPGGLTGP

SEQ ID NO: 7102 - protein, 19 aa, synthetic construct
TTARAGGAENLTPAGLTEP

SEQ ID NO: 7103 - protein, 19 aa, synthetic construct
TTARAGSAENLSPSGLTGP

SEQ ID NO: 7104 - protein, 19 aa, synthetic construct
TTARAGGAGNLAPEGLTTP

SEQ ID NO: 7105 - protein, 19 aa, synthetic construct
TTSRAGAAENLTPTGLTGP

SEQ ID NO: 7106 - protein, 19 aa, synthetic construct
TYGRTTTPGNEPPASLEAE

SEQ ID NO: 7107 - protein, 19 aa, synthetic construct
TYSRGESGPNEPPPGLTGP

SEQ ID NO: 7108 - protein, 19 aa, synthetic construct
AWGRTGASENETPAPLGGE

SEQ ID NO: 7109 - protein, 19 aa, synthetic construct
RWGRAETTPNTPPEGLETE

SEQ ID NO: 7110 - protein, 19 aa, synthetic construct
ESGRAANHTGAEPPELGAG

SEQ ID NO: 7111 - protein, 19 aa, synthetic construct
TTGRAGEAANLTPAGLTES

SEQ ID NO: 7112 - protein, 19 aa, synthetic construct
TTGRAGEAANLTPAALTES

SEQ ID NO: 7113 - protein, 19 aa, synthetic construct
TTGRAGEAANLTPAPLTES

SEQ ID NO: 7114 - protein, 19 aa, synthetic construct
TTGRAGEAANLTPEPLTES

SEQ ID NO: 7115 - protein, 19 aa, synthetic construct
TTGRAGEAANLTPAGLTGA

SEQ ID NO: 7116 - protein, 19 aa, synthetic construct
TTGRAGEAANLTPEGLTGA

SEQ ID NO: 7117 - protein, 19 aa, synthetic construct
TTGRAGEAANLTPEPLTGA

SEQ ID NO: 7118 - protein, 19 aa, synthetic construct
TTGRAGEAANLTPAGLTEA

SEQ ID NO: 7119 - protein, 19 aa, synthetic construct
TTGRAGEAANLTPEGLTEA

SEQ ID NO: 7120 - protein, 19 aa, synthetic construct
TTGRAGEAANLTPAPLTEA

SEQ ID NO: 7121 - protein, 19 aa, synthetic construct
TTGRAGEAANLTPEPLTEA

SEQ ID NO: 7122 - protein, 19 aa, synthetic construct
TTGRAGEAANLTPEPLTGP

SEQ ID NO: 7123 - protein, 19 aa, synthetic construct
TTGRAGEAANLTPAGLTGG

SEQ ID NO: 7124 - protein, 19 aa, synthetic construct
TTGRAGEAANLTPEGLTGG

SEQ ID NO: 7125 - protein, 19 aa, synthetic construct
TTGRAGEAANLTPEALTGG

SEQ ID NO: 7126 - protein, 19 aa, synthetic construct
TTGRAGEAANLTPEPLTGG

SEQ ID NO: 7127 - protein, 19 aa, synthetic construct
TTGRAGEAANLTPAGLTEG

SEQ ID NO: 7128 - protein, 19 aa, synthetic construct
TTGRAGEAANLTPEGLTEG

SEQ ID NO: 7129 - protein, 19 aa, synthetic construct
TTGRAGEAANLTPAPLTEG

SEQ ID NO: 7130 - protein, 19 aa, synthetic construct
TTGRAGEAANLTPEPLTEG

SEQ ID NO: 7131 - protein, 29 aa, synthetic construct
GSAPGSAGGYAELRMGGAIATSGSETPGT

SEQ ID NO: 7132 - protein, 29 aa, synthetic construct
GSAPGTGGGYAPLRMGGGAATSGSETPGT

SEQ ID NO: 7133 - protein, 29 aa, synthetic construct
GSAPGAEGGYAALRMGGEIATSGSETPGT

SEQ ID NO: 7134 - protein, 29 aa, synthetic construct
GSAPGGPGGYALLRMGGPAATSGSETPGT

SEQ ID NO: 7135 - protein, 29 aa, synthetic construct
GSAPGEAGGYAFLRMGGSIATSGSETPGT

SEQ ID NO: 7136 - protein, 29 aa, synthetic construct
GSAPGPGGGYASLRMGGTAATSGSETPGT

SEQ ID NO: 7137 - protein, 29 aa, synthetic construct
GSAPGSEGGYATLRMGGAIATSGSETPGT

SEQ ID NO: 7138 - protein, 29 aa, synthetic construct
GSAPGTPGGYANLRMGGGAATSGSETPGT

SEQ ID NO: 7139 - protein, 29 aa, synthetic construct
GSAPGASGGYAHLRMGGEIATSGSETPGT

SEQ ID NO: 7140 - protein, 29 aa, synthetic construct
GSAPGGTGGYGELRMGGPAATSGSETPGT

SEQ ID NO: 7141 - protein, 29 aa, synthetic construct
GSAPGEAGGYPELRMGGSIATSGSETPGT

SEQ ID NO: 7142 - protein, 29 aa, synthetic construct
GSAPGPGGGYVELRMGGTAATSGSETPGT

SEQ ID NO: 7143 - protein, 29 aa, synthetic construct
GSAPGSEGGYLELRMGGAIATSGSETPGT

SEQ ID NO: 7144 - protein, 29 aa, synthetic construct
GSAPGTPGGYSELRMGGGAATSGSETPGT

SEQ ID NO: 7145 - protein, 29 aa, synthetic construct
GSAPGASGGYTELRMGGEIATSGSETPGT

SEQ ID NO: 7146 - protein, 29 aa, synthetic construct
GSAPGGTGGYQELRMGGPAATSGSETPGT

SEQ ID NO: 7147 - protein, 29 aa, synthetic construct
GSAPGEAGGYEELRMGGSIATSGSETPGT

SEQ ID NO: 7148 - protein, 29 aa, synthetic construct
GSAPGPGIGPAELRMGGTAATSGSETPGT

SEQ ID NO: 7149 - protein, 29 aa, synthetic construct
GSAPGSEIGAAELRMGGAIATSGSETPGT

SEQ ID NO: 7150 - protein, 29 aa, synthetic construct
GSAPGTPIGSAELRMGGGAATSGSETPGT

SEQ ID NO: 7151 - protein, 29 aa, synthetic construct
GSAPGASIGTAELRMGGEIATSGSETPGT

SEQ ID NO: 7152 - protein, 29 aa, synthetic construct
GSAPGGTIGNAELRMGGPAATSGSETPGT

SEQ ID NO: 7153 - protein, 29 aa, synthetic construct
GSAPGEAIGQAELRMGGSIATSGSETPGT

SEQ ID NO: 7154 - protein, 29 aa, synthetic construct
GSAPGPGGPYAELRMGGTAATSGSETPGT

SEQ ID NO: 7155 - protein, 29 aa, synthetic construct
GSAPGSEGAYAELRMGGAIATSGSETPGT

SEQ ID NO: 7156 - protein, 29 aa, synthetic construct
GSAPGTPGVYAELRMGGGAATSGSETPGT

SEQ ID NO: 7157 - protein, 29 aa, synthetic construct
GSAPGASGLYAELRMGGEIATSGSETPGT

SEQ ID NO: 7158 - protein, 29 aa, synthetic construct
GSAPGGTGIYAELRMGGPAATSGSETPGT

SEQ ID NO: 7159 - protein, 29 aa, synthetic construct
GSAPGEAGFYAELRMGGSIATSGSETPGT

SEQ ID NO: 7160 - protein, 29 aa, synthetic construct
GSAPGPGGYYAELRMGGTAATSGSETPGT

SEQ ID NO: 7161 - protein, 29 aa, synthetic construct
GSAPGSEGSYAELRMGGAIATSGSETPGT

SEQ ID NO: 7162 - protein, 29 aa, synthetic construct
GSAPGTPGNYAELRMGGGAATSGSETPGT

SEQ ID NO: 7163 - protein, 29 aa, synthetic construct
GSAPGASGEYAELRMGGEIATSGSETPGT

SEQ ID NO: 7164 - protein, 29 aa, synthetic construct
GSAPGGTGHYAELRMGGPAATSGSETPGT

SEQ ID NO: 7165 - protein, 29 aa, synthetic construct
GSAPGEAGGYAEARMGGSIATSGSETPGT

SEQ ID NO: 7166 - protein, 29 aa, synthetic construct
GSAPGPGGGYAEVRMGGTAATSGSETPGT

SEQ ID NO: 7167 - protein, 29 aa, synthetic construct
GSAPGSEGGYAEIRMGGAIATSGSETPGT

SEQ ID NO: 7168 - protein, 29 aa, synthetic construct
GSAPGTPGGYAEFRMGGGAATSGSETPGT

SEQ ID NO: 7169 - protein, 29 aa, synthetic construct
GSAPGASGGYAEYRMGGEIATSGSETPGT

SEQ ID NO: 7170 - protein, 29 aa, synthetic construct
GSAPGGTGGYAESRMGGPAATSGSETPGT

SEQ ID NO: 7171 - protein, 29 aa, synthetic construct
GSAPGEAGGYAETRMGGSIATSGSETPGT

SEQ ID NO: 7172 - protein, 29 aa, synthetic construct
GSAPGPGGGYAELAMGGTRATSGSETPGT

SEQ ID NO: 7173 - protein, 29 aa, synthetic construct
GSAPGSEGGYAELVMGGARATSGSETPGT

SEQ ID NO: 7174 - protein, 29 aa, synthetic construct
GSAPGTPGGYAELLMGGGRATSGSETPGT

SEQ ID NO: 7175 - protein, 29 aa, synthetic construct
GSAPGASGGYAELIMGGERATSGSETPGT

SEQ ID NO: 7176 - protein, 29 aa, synthetic construct
GSAPGGTGGYAELWMGGPRATSGSETPGT

SEQ ID NO: 7177 - protein, 29 aa, synthetic construct
GSAPGEAGGYAELSMGGSRATSGSETPGT

SEQ ID NO: 7178 - protein, 29 aa, synthetic construct
GSAPGPGGGYAELTMGGTRATSGSETPGT

SEQ ID NO: 7179 - protein, 29 aa, synthetic construct
GSAPGSEGGYAELQMGGARATSGSETPGT

SEQ ID NO: 7180 - protein, 29 aa, synthetic construct
GSAPGTPGGYAELNMGGGRATSGSETPGT

SEQ ID NO: 7181 - protein, 29 aa, synthetic construct
GSAPGASGGYAELEMGGERATSGSETPGT

SEQ ID NO: 7182 - protein, 29 aa, synthetic construct
GSAPGGTGGYAELRPGGPIATSGSETPGT

SEQ ID NO: 7183 - protein, 29 aa, synthetic construct
GSAPGEAGGYAELRAGGSAATSGSETPGT

SEQ ID NO: 7184 - protein, 29 aa, synthetic construct
GSAPGPGGGYAELRLGGTIATSGSETPGT

SEQ ID NO: 7185 - protein, 29 aa, synthetic construct
GSAPGSEGGYAELRIGGAAATSGSETPGT

SEQ ID NO: 7186 - protein, 29 aa, synthetic construct
GSAPGTPGGYAELRSGGGIATSGSETPGT

SEQ ID NO: 7187 - protein, 29 aa, synthetic construct
GSAPGASGGYAELRNGGEAATSGSETPGT

SEQ ID NO: 7188 - protein, 29 aa, synthetic construct
GSAPGGTGGYAELRQGGPIATSGSETPGT

SEQ ID NO: 7189 - protein, 29 aa, synthetic construct
GSAPGEAGGYAELRDGGSAATSGSETPGT

SEQ ID NO: 7190 - protein, 29 aa, synthetic construct
GSAPGPGGGYAELREGGTIATSGSETPGT

SEQ ID NO: 7191 - protein, 29 aa, synthetic construct
GSAPGSEGGYAELRHGGAAATSGSETPGT

SEQ ID NO: 7192 - protein, 29 aa, synthetic construct
GSAPGTPGGYAELRMPGGIATSGSETPGT

SEQ ID NO: 7193 - protein, 29 aa, synthetic construct
GSAPGASGGYAELRMAGEAATSGSETPGT

SEQ ID NO: 7194 - protein, 29 aa, synthetic construct
GSAPGGTGGYAELRMVGPIATSGSETPGT

SEQ ID NO: 7195 - protein, 29 aa, synthetic construct
GSAPGEAGGYAELRMLGSAATSGSETPGT

SEQ ID NO: 7196 - protein, 29 aa, synthetic construct
GSAPGPGGGYAELRMIGTIATSGSETPGT

SEQ ID NO: 7197 - protein, 29 aa, synthetic construct
GSAPGSEGGYAELRMYGAIATSGSETPGT

SEQ ID NO: 7198 - protein, 29 aa, synthetic construct
GSAPGTPGGYAELRMSGGAATSGSETPGT

SEQ ID NO: 7199 - protein, 29 aa, synthetic construct
GSAPGASGGYAELRMNGEIATSGSETPGT

SEQ ID NO: 7200 - protein, 29 aa, synthetic construct
GSAPGGTGGYAELRMQGPAATSGSETPGT

SEQ ID NO: 7201 - protein, 29 aa, synthetic construct
GSAPGANHTPAGLTGPGARATSGSETPGT

SEQ ID NO: 7202 - protein, 29 aa, synthetic construct
GSAPGANTAPEGLTGPSTRATSGSETPGT

SEQ ID NO: 7203 - protein, 29 aa, synthetic construct
GSAPGTGAPPGGLTGPGTRATSGSETPGT

SEQ ID NO: 7204 - protein, 29 aa, synthetic construct
GSAPGANHEPSGLTEGSPRATSGSETPGT

SEQ ID NO: 7205 - protein, 29 aa, synthetic construct
GSAPGANTEPPELGAGTERATSGSETPGT

SEQ ID NO: 7206 - protein, 29 aa, synthetic construct
GSAPGASGPPPGLTGPPGRATSGSETPGT

SEQ ID NO: 7207 - protein, 29 aa, synthetic construct
GSAPGASGTPAPLGGEPGRATSGSETPGT

SEQ ID NO: 7208 - protein, 29 aa, synthetic construct
GSAPGPAGPPEGLETEAGRATSGSETPGT

SEQ ID NO: 7209 - protein, 29 aa, synthetic construct
GSAPGPTSGQGGLTGPESRATSGSETPGT

SEQ ID NO: 7210 - protein, 29 aa, synthetic construct
GSAPGSAGGAANLVRGGAIATSGSETPGT

SEQ ID NO: 7211 - protein, 29 aa, synthetic construct
GSAPGTGGGAAPLVRGGGAATSGSETPGT

SEQ ID NO: 7212 - protein, 29 aa, synthetic construct
GSAPGAEGGAAALVRGGEIATSGSETPGT

SEQ ID NO: 7213 - protein, 29 aa, synthetic construct
GSAPGGPGGAALLVRGGPAATSGSETPGT

SEQ ID NO: 7214 - protein, 29 aa, synthetic construct
GSAPGEAGGAAFLVRGGSIATSGSETPGT

SEQ ID NO: 7215 - protein, 29 aa, synthetic construct
GSAPGPGGGAASLVRGGTAATSGSETPGT

SEQ ID NO: 7216 - protein, 29 aa, synthetic construct
GSAPGSEGGAATLVRGGAIATSGSETPGT

SEQ ID NO: 7217 - protein, 29 aa, synthetic construct
GSAPGTPGGAAGLVRGGGAATSGSETPGT

SEQ ID NO: 7218 - protein, 29 aa, synthetic construct
GSAPGASGGAADLVRGGEIATSGSETPGT

SEQ ID NO: 7219 - protein, 29 aa, synthetic construct
GSAPGGTGGAGNLVRGGPAATSGSETPGT

SEQ ID NO: 7220 - protein, 29 aa, synthetic construct
GSAPGEAGGAPNLVRGGSIATSGSETPGT

SEQ ID NO: 7221 - protein, 29 aa, synthetic construct
GSAPGPGGGAVNLVRGGTAATSGSETPGT

SEQ ID NO: 7222 - protein, 29 aa, synthetic construct
GSAPGSEGGALNLVRGGAIATSGSETPGT

SEQ ID NO: 7223 - protein, 29 aa, synthetic construct
GSAPGTPGGASNLVRGGGAATSGSETPGT

SEQ ID NO: 7224 - protein, 29 aa, synthetic construct
GSAPGASGGATNLVRGGEIATSGSETPGT

SEQ ID NO: 7225 - protein, 29 aa, synthetic construct
GSAPGGTGGAQNLVRGGPAATSGSETPGT

SEQ ID NO: 7226 - protein, 29 aa, synthetic construct
GSAPGEAGGAENLVRGGSIATSGSETPGT

SEQ ID NO: 7227 - protein, 30 aa, synthetic construct
GSAPEAGRSANHEPLGLVATATSGSETPGT

SEQ ID NO: 7228 - protein, 30 aa, synthetic construct
GSAPASGRSTNAGPSGLAGPATSGSETPGT

SEQ ID NO: 7229 - protein, 30 aa, synthetic construct
GSAPASGRSTNAGPQGLAGQATSGSETPGT

SEQ ID NO: 7230 - protein, 30 aa, synthetic construct
GSAPASGRSTNAGPPGLTGPATSGSETPGT

SEQ ID NO: 7231 - protein, 30 aa, synthetic construct
GSAPASSRGTNAGPAGLTGPATSGSETPGT

SEQ ID NO: 7232 - protein, 30 aa, synthetic construct
GSAPASSRTTNTGPSTLTGPATSGSETPGT

SEQ ID NO: 7233 - protein, 30 aa, synthetic construct
GSAPAAGRSDNGTPLELVAPATSGSETPGT

SEQ ID NO: 7234 - protein, 30 aa, synthetic construct; identical to SEQ ID NO: 7227

SEQ ID NO: 7235 - protein, 30 aa, synthetic construct
GSAPASGRGTNAGPAGLTGPATSGSETPGT

SEQ ID NO: 7236 - protein, 30 aa, synthetic construct
GSAPLFGRNDNHEPLELGGGATSGSETPGT

SEQ ID NO: 7237 - protein, 30 aa, synthetic construct
GSAPTAGRSDNLEPLGLVFGATSGSETPGT

SEQ ID NO: 7238 - protein, 30 aa, synthetic construct
GSAPLDGRSDNFHPPELVAGATSGSETPGT

SEQ ID NO: 7239 - protein, 30 aa, synthetic construct
GSAPLEGRSDNEEPENLVAGATSGSETPGT

SEQ ID NO: 7240 - protein, 30 aa, synthetic construct
GSAPLKGRSDNNAPLALVAGATSGSETPGT

SEQ ID NO: 7241 - protein, 30 aa, synthetic construct
GSAPVYSRGTNAGPHGLTGRATSGSETPGT

SEQ ID NO: 7242 - protein, 30 aa, synthetic construct
GSAPANSRGTNKGFAGLIGPATSGSETPGT

SEQ ID NO: 7243 - protein, 30 aa, synthetic construct
GSAPASSRLTNEAPAGLTIPATSGSETPGT

SEQ ID NO: 7244 - protein, 30 aa, synthetic construct
GSAPDQSRGTNAGPEGLTDPATSGSETPGT

SEQ ID NO: 7245 - protein, 30 aa, synthetic construct
GSAPESSRGTNIGQGGLTGPATSGSETPGT

SEQ ID NO: 7246 - protein, 30 aa, synthetic construct
GSAPSSSRGTNQDPAGLTIPATSGSETPGT

SEQ ID NO: 7247 - protein, 30 aa, synthetic construct
GSAPASSRGQNHSPMGLTGPATSGSETPGT

SEQ ID NO: 7248 - protein, 30 aa, synthetic construct
GSAPAYSRGPNAGPAGLEGRATSGSETPGT

SEQ ID NO: 7249 - protein, 30 aa, synthetic construct
GSAPASERGNNAGPANLTGFATSGSETPGT

SEQ ID NO: 7250 - protein, 30 aa, synthetic construct
GSAPASHRGTNPKPAILTGPATSGSETPGT

SEQ ID NO: 7251 - protein, 30 aa, synthetic construct
GSAPMSSRRTNANPAQLTGPATSGSETPGT

SEQ ID NO: 7252 - protein, 30 aa, synthetic construct
GSAPGAGRTDNHEPLELGAAATSGSETPGT

SEQ ID NO: 7253 - protein, 30 aa, synthetic construct
GSAPLAGRSENTAPLELTAGATSGSETPGT

SEQ ID NO: 7254 - protein, 30 aa, synthetic construct
GSAPLEGRPDNHEPLALVASATSGSETPGT

SEQ ID NO: 7255 - protein, 30 aa, synthetic construct
GSAPLSGRSDNEEPLALPAGATSGSETPGT

SEQ ID NO: 7256 - protein, 30 aa, synthetic construct
GSAPEAGRTDNHEPLELSAPATSGSETPGT

SEQ ID NO: 7257 - protein, 30 aa, synthetic construct
GSAPEGGRSDNHGPLELVSGATSGSETPGT

SEQ ID NO: 7258 - protein, 30 aa, synthetic construct
GSAPLSGRSDNEAPLELEAGATSGSETPGT

SEQ ID NO: 7259 - protein, 30 aa, synthetic construct
GSAPLGGRADNHEPPELGAGATSGSETPGT

SEQ ID NO: 7260 - protein, 30 aa, synthetic construct
GSAPPPSRGTNAEPAGLTGEATSGSETPGT

SEQ ID NO: 7261 - protein, 30 aa, synthetic construct
GSAPASTRGENAGPAGLEAPATSGSETPGT

SEQ ID NO: 7262 - protein, 30 aa, synthetic construct
GSAPESSRGTNGAPEGLTGPATSGSETPGT

SEQ ID NO: 7263 - protein, 30 aa, synthetic construct
GSAPASSRATNESPAGLTGEATSGSETPGT

SEQ ID NO: 7264 - protein, 30 aa, synthetic construct
GSAPASSRGENPPPGGLTGPATSGSETPGT

SEQ ID NO: 7265 - protein, 30 aa, synthetic construct
GSAPAASRGTNTGPAELTGSATSGSETPGT

SEQ ID NO: 7266 - protein, 30 aa, synthetic construct
GSAPAGSRTTNAGPGGLEGPATSGSETPGT

SEQ ID NO: 7267 - protein, 30 aa, synthetic construct
GSAPAPSRGENAGPATLTGAATSGSETPGT

SEQ ID NO: 7268 - protein, 30 aa, synthetic construct
GSAPESGRAANTGPPTLTAPATSGSETPGT

SEQ ID NO: 7269 - protein, 30 aa, synthetic construct
GSAPNPGRAANEGPPGLPGSATSGSETPGT

SEQ ID NO: 7270 - protein, 30 aa, synthetic construct
GSAPESSRAANLTPPELTGPATSGSETPGT

SEQ ID NO: 7271 - protein, 30 aa, synthetic construct
GSAPASGRAANETPPGLTGAATSGSETPGT

SEQ ID NO: 7272 - protein, 30 aa, synthetic construct
GSAPNSGRGENLGAPGLTGTATSGSETPGT

SEQ ID NO: 7273 - protein, 30 aa, synthetic construct
GSAPTTGRAANLTPAGLTGPATSGSETPGT

SEQ ID NO: 7274 - protein, 30 aa, synthetic construct
GSAPEAGRSANHTPAGLTGPATSGSETPGT

SEQ ID NO: 7275 - protein, 30 aa, synthetic construct
GSAPESGRAANTTPAGLTGPATSGSETPGT

SEQ ID NO: 7276 - protein, 33 aa, synthetic construct
GSAPTTGRATEAANLTPAGLTGPATSGSETPGT

SEQ ID NO: 7277 - protein, 33 aa, synthetic construct
GSAPTTGRAEEAANLTPAGLTGPATSGSETPGT

SEQ ID NO: 7278 - protein, 33 aa, synthetic construct
GSAPTTGRAGEAANLTPAGLTGPATSGSETPGT

SEQ ID NO: 7279 - protein, 33 aa, synthetic construct
GSAPTTGRATEAANATPAGLTGPATSGSETPGT

SEQ ID NO: 7280 - protein, 33 aa, synthetic construct
GSAPTTGRAGEAEGATSAGATGPATSGSETPGT

SEQ ID NO: 7281 - protein, 33 aa, synthetic construct
GSAPTTGEAGEAANATSAGATGPATSGSETPGT

SEQ ID NO: 7282 - protein, 33 aa, synthetic construct
GSAPTTGEAGEAAGLTPAGLTGPATSGSETPGT

SEQ ID NO: 7283 - protein, 33 aa, synthetic construct
GSAPTTGAAGEAANATPAGLTGPATSGSETPGT

SEQ ID NO: 7284 - protein, 33 aa, synthetic construct
GSAPTTGRAGEAAGLTPAGLTGPATSGSETPGT

SEQ ID NO: 7285 - protein, 33 aa, synthetic construct
GSAPTTGRAGEAANATSAGATGPATSGSETPGT

SEQ ID NO: 7286 - protein, 33 aa, synthetic construct
GSAPTTGEAGEAAGATSAGATGPATSGSETPGT

SEQ ID NO: 7287 - protein, 30 aa, synthetic construct
GSAPESGRAANTEPPELGAGATSGSETPGT

SEQ ID NO: 7288 - protein, 30 aa, synthetic construct
GSAPESGRAANTAPEGLTGPATSGSETPGT

SEQ ID NO: 7289 - protein, 30 aa, synthetic construct
GSAPEPGRAANHEPSGLTEGATSGSETPGT

SEQ ID NO: 7290 - protein, 33 aa, synthetic construct
GSAPESGRAANHTGAPPGGLTGPATSGSETPGT

SEQ ID NO: 7291 - protein, 33 aa, synthetic construct
GSAPTTGRTGEGANATPGGLTGPATSGSETPGT

SEQ ID NO: 7292 - protein, 33 aa, synthetic construct
GSAPRTGRSGEAANETPEGLEGPATSGSETPGT

SEQ ID NO: 7293 - protein, 33 aa, synthetic construct
GSAPRTGRTGESANETPAGLGGPATSGSETPGT

SEQ ID NO: 7294 - protein, 33 aa, synthetic construct
GSAPSTGRTGEPANETPAGLSGPATSGSETPGT

SEQ ID NO: 7295 - protein, 33 aa, synthetic construct
GSAPTTGRAGEPANATPTGLSGPATSGSETPGT

SEQ ID NO: 7296 - protein, 33 aa, synthetic construct
GSAPRTGRPGEGANATPTGLPGPATSGSETPGT

SEQ ID NO: 7297 - protein, 33 aa, synthetic construct
GSAPRTGRGGEAANATPSGLGGPATSGSETPGT

SEQ ID NO: 7298 - protein, 33 aa, synthetic construct
GSAPSTGRSGESANATPGGLGGPATSGSETPGT

SEQ ID NO: 7299 - protein, 33 aa, synthetic construct
GSAPRTGRTGEEANATPAGLPGPATSGSETPGT

SEQ ID NO: 7300 - protein, 33 aa, synthetic construct
GSAPATGRPGEPANTTPEGLEGPATSGSETPGT

SEQ ID NO: 7301 - protein, 33 aa, synthetic construct
GSAPSTGRSGEPANATPGGLTGPATSGSETPGT

SEQ ID NO: 7302 - protein, 33 aa, synthetic construct
GSAPPTGRGGEGANTTPTGLPGPATSGSETPGT

SEQ ID NO: 7303 - protein, 33 aa, synthetic construct
GSAPPTGRSGEGANATPSGLTGPATSGSETPGT

SEQ ID NO: 7304 - protein, 33 aa, synthetic construct
GSAPTTGRASEGANSTPAPLTEPATSGSETPGT

SEQ ID NO: 7305 - protein, 33 aa, synthetic construct
GSAPTYGRAAEAANTTPAGLTAPATSGSETPGT

SEQ ID NO: 7306 - protein, 33 aa, synthetic construct
GSAPTTGRATEGANATPAELTEPATSGSETPGT

SEQ ID NO: 7307 - protein, 33 aa, synthetic construct
GSAPTVGRASEEANTTPASLTGPATSGSETPGT

SEQ ID NO: 7308 - protein, 33 aa, synthetic construct
GSAPTTGRAPEAANATPAPLTGPATSGSETPGT

SEQ ID NO: 7309 - protein, 33 aa, synthetic construct
GSAPTWGRATEPANATPAPLTSPATSGSETPGT

SEQ ID NO: 7310 - protein, 33 aa, synthetic construct
GSAPTVGRASESANATPAELTSPATSGSETPGT

SEQ ID NO: 7311 - protein, 33 aa, synthetic construct
GSAPTVGRAPEGANSTPAGLTGPATSGSETPGT

SEQ ID NO: 7312 - protein, 33 aa, synthetic construct
GSAPTWGRATEAPNLEPATLTTPATSGSETPGT

SEQ ID NO: 7313 - protein, 33 aa, synthetic construct
GSAPTTGRATEAPNLTPAPLTEPATSGSETPGT

SEQ ID NO: 7314 - protein, 33 aa, synthetic construct
GSAPTQGRATEAPNLSPAALTSPATSGSETPGT

SEQ ID NO: 7315 - protein, 33 aa, synthetic construct
GSAPTQGRAAEAPNLTPATLTAPATSGSETPGT

SEQ ID NO: 7316 - protein, 33 aa, synthetic construct
GSAPTSGRAPEATNLAPAPLTGPATSGSETPGT

SEQ ID NO: 7317 - protein, 33 aa, synthetic construct
GSAPTQGRAAEAANLTPAGLTEPATSGSETPGT

SEQ ID NO: 7318 - protein, 33 aa, synthetic construct
GSAPTTGRAGSAPNLPPTGLTTPATSGSETPGT

SEQ ID NO: 7319 - protein, 33 aa, synthetic construct
GSAPTTGRAGGAENLPPEGLTAPATSGSETPGT

SEQ ID NO: 7320 - protein, 33 aa, synthetic construct
GSAPTTSRAGTATNLTPEGLTAPATSGSETPGT

SEQ ID NO: 7321 - protein, 33 aa, synthetic construct
GSAPTTGRAGTATNLPPSGLTTPATSGSETPGT

SEQ ID NO: 7322 - protein, 33 aa, synthetic construct
GSAPTTARAGEAENLSPSGLTAPATSGSETPGT

SEQ ID NO: 7323 - protein, 33 aa, synthetic construct
GSAPTTGRAGGAGNLAPGGLTEPATSGSETPGT

SEQ ID NO: 7324 - protein, 33 aa, synthetic construct
GSAPTTGRAGTATNLPPEGLTGPATSGSETPGT

SEQ ID NO: 7325 - protein, 33 aa, synthetic construct
GSAPTTGRAGGAANLAPTGLTEPATSGSETPGT

SEQ ID NO: 7326 - protein, 33 aa, synthetic construct
GSAPTTGRAGTAENLAPSGLTTPATSGSETPGT

SEQ ID NO: 7327 - protein, 33 aa, synthetic construct
GSAPTTGRAGSATNLGPGGLTGPATSGSETPGT

SEQ ID NO: 7328 - protein, 33 aa, synthetic construct
GSAPTTARAGGAENLTPAGLTEPATSGSETPGT

SEQ ID NO: 7329 - protein, 33 aa, synthetic construct
GSAPTTARAGSAENLSPSGLTGPATSGSETPGT

SEQ ID NO: 7330 - protein, 33 aa, synthetic construct
GSAPTTARAGGAGNLAPEGLTTPATSGSETPGT

SEQ ID NO: 7331 - protein, 33 aa, synthetic construct
GSAPTTSRAGAAENLTPTGLTGPATSGSETPGT

SEQ ID NO: 7332 - protein, 33 aa, synthetic construct
GSAPTYGRTTTPGNEPPASLEAEATSGSETPGT

SEQ ID NO: 7333 - protein, 33 aa, synthetic construct
GSAPTYSRGESGPNEPPPGLTGPATSGSETPGT

SEQ ID NO: 7334 - protein, 33 aa, synthetic construct
GSAPAWGRTGASENETPAPLGGEATSGSETPGT

SEQ ID NO: 7335 - protein, 33 aa, synthetic construct
GSAPRWGRAETTPNTPPEGLETEATSGSETPGT

SEQ ID NO: 7336 - protein, 33 aa, synthetic construct
GSAPESGRAANHTGAEPPELGAGATSGSETPGT

SEQ ID NO: 7337 - protein, 33 aa, synthetic construct
GSAPTTGRAGEAANLTPAGLTESATSGSETPGT

SEQ ID NO: 7338 - protein, 33 aa, synthetic construct
GSAPTTGRAGEAANLTPAALTESATSGSETPGT

SEQ ID NO: 7339 - protein, 33 aa, synthetic construct
GSAPTTGRAGEAANLTPAPLTESATSGSETPGT

SEQ ID NO: 7340 - protein, 33 aa, synthetic construct
GSAPTTGRAGEAANLTPEPLTESATSGSETPGT

SEQ ID NO: 7341 - protein, 33 aa, synthetic construct
GSAPTTGRAGEAANLTPAGLTGAATSGSETPGT

SEQ ID NO: 7342 - protein, 33 aa, synthetic construct
GSAPTTGRAGEAANLTPEGLTGAATSGSETPGT

SEQ ID NO: 7343 - protein, 33 aa, synthetic construct
GSAPTTGRAGEAANLTPEPLTGAATSGSETPGT

SEQ ID NO: 7344 - protein, 33 aa, synthetic construct
GSAPTTGRAGEAANLTPAGLTEAATSGSETPGT

SEQ ID NO: 7345 - protein, 33 aa, synthetic construct
GSAPTTGRAGEAANLTPEGLTEAATSGSETPGT

SEQ ID NO: 7346 - protein, 33 aa, synthetic construct
GSAPTTGRAGEAANLTPAPLTEAATSGSETPGT

SEQ ID NO: 7347 - protein, 33 aa, synthetic construct
GSAPTTGRAGEAANLTPEPLTEAATSGSETPGT

SEQ ID NO: 7348 - protein, 33 aa, synthetic construct
GSAPTTGRAGEAANLTPEPLTGPATSGSETPGT

SEQ ID NO: 7349 - protein, 33 aa, synthetic construct
GSAPTTGRAGEAANLTPAGLTGGATSGSETPGT

SEQ ID NO: 7350 - protein, 33 aa, synthetic construct
GSAPTTGRAGEAANLTPEGLTGGATSGSETPGT

SEQ ID NO: 7351 - protein, 33 aa, synthetic construct
GSAPTTGRAGEAANLTPEALTGGATSGSETPGT

SEQ ID NO: 7352 - protein, 33 aa, synthetic construct
GSAPTTGRAGEAANLTPEPLTGGATSGSETPGT

SEQ ID NO: 7353 - protein, 33 aa, synthetic construct
GSAPTTGRAGEAANLTPAGLTEGATSGSETPGT

SEQ ID NO: 7354 - protein, 33 aa, synthetic construct
GSAPTTGRAGEAANLTPEGLTEGATSGSETPGT

SEQ ID NO: 7355 - protein, 33 aa, synthetic construct
GSAPTTGRAGEAANLTPAPLTEGATSGSETPGT

SEQ ID NO: 7356 - protein, 33 aa, synthetic construct
GSAPTTGRAGEAANLTPEPLTEGATSGSETPGT

SEQ ID NO: 7357 - protein, 33 aa, synthetic construct; identical to SEQ ID NO: 7280

SEQ ID NO: 7358 - protein, 30 aa, synthetic construct
GSAPEAGRSAEATSAGATGPATSGSETPGT

SEQ ID NO: 7359 - protein, 30 aa, synthetic construct
GSAPSASGTYSRGESGPGSPATSGSETPGT

SEQ ID NO: 7360 - protein, 30 aa, synthetic construct
GSAPSASGEAGRTDTHPGSPATSGSETPGT

SEQ ID NO: 7361 - protein, 30 aa, synthetic construct
GSAPSASGEPGRAAEHPGSPATSGSETPGT

SEQ ID NO: 7362 - protein, 30 aa, synthetic construct
GSAPSPAGESSRGTTIAGSPATSGSETPGT

SEQ ID NO: 7363 - protein, 33 aa, synthetic construct; identical to SEQ ID NO: 7282

SEQ ID NO: 7364 - protein, 30 aa, synthetic construct
GSAPEAGESAGATPAGLTGPATSGSETPGT

SEQ ID NO: 7365 - protein, 30 aa, synthetic construct
GSAPSASGAPLELEAGPGSPATSGSETPGT

SEQ ID NO: 7366 - protein, 30 aa, synthetic construct
GSAPSASGEPPELGAGPGSPATSGSETPGT

SEQ ID NO: 7367 - protein, 30 aa, synthetic construct
GSAPSASGEPSGLTEGPGSPATSGSETPGT

SEQ ID NO: 7368 - protein, 30 aa, synthetic construct
GSAPSASGTPAPLTEPPGSPATSGSETPGT

SEQ ID NO: 7369 - protein, 30 aa, synthetic construct
GSAPSASGTPAELTEPPGSPATSGSETPGT

SEQ ID NO: 7370 - protein, 30 aa, synthetic construct
GSAPSASGPPPGLTGPPGSPATSGSETPGT

SEQ ID NO: 7371 - protein, 30 aa, synthetic construct
GSAPSASGTPAPLGGEPGSPATSGSETPGT

SEQ ID NO: 7372 - protein, 30 aa, synthetic construct
GSAPSPAGAPEGLTGPAGSPATSGSETPGT

SEQ ID NO: 7373 - protein, 30 aa, synthetic construct
GSAPSPAGPPEGLETEAGSPATSGSETPGT

SEQ ID NO: 7374 - protein, 30 aa, synthetic construct
GSAPSPTSGQGGLTGPGSEPATSGSETPGT

SEQ ID NO: 7375 - protein, 30 aa, synthetic construct
GSAPSESAPPEGLETESTEPATSGSETPGT

SEQ ID NO: 7376 - protein, 30 aa, synthetic construct
GSAPSEGSEPLELGAASETPATSGSETPGT

SEQ ID NO: 7377 - protein, 30 aa, synthetic construct
GSAPSEGSGPAGLEAPSETPATSGSETPGT

SEQ ID NO: 7378 - protein, 30 aa, synthetic construct
GSAPSEPTPPASLEAEPGSPATSGSETPGT

SEQ ID NO: 7379 - protein, 29 aa, synthetic construct
GTAEAASASGGSAGGYAELRMGGAIPGSP

SEQ ID NO: 7380 - protein, 29 aa, synthetic construct
GTAEAASASGGTGGGYAPLRMGGGAPGSP

SEQ ID NO: 7381 - protein, 29 aa, synthetic construct
GTAEAASASGGAEGGYAALRMGGEIPGSP

SEQ ID NO: 7382 - protein, 29 aa, synthetic construct
GTAEAASASGGGPGGYALLRMGGPAPGSP

SEQ ID NO: 7383 - protein, 29 aa, synthetic construct
GTAEAASASGGEAGGYAFLRMGGSIPGSP

SEQ ID NO: 7384 - protein, 29 aa, synthetic construct
GTAEAASASGGPGGGYASLRMGGTAPGSP

SEQ ID NO: 7385 - protein, 29 aa, synthetic construct
GTAEAASASGGSEGGYATLRMGGAIPGSP

SEQ ID NO: 7386 - protein, 29 aa, synthetic construct
GTAEAASASGGTPGGYANLRMGGGAPGSP

SEQ ID NO: 7387 - protein, 29 aa, synthetic construct
GTAEAASASGGASGGYAHLRMGGEIPGSP

SEQ ID NO: 7388 - protein, 29 aa, synthetic construct
GTAEAASASGGGTGGYGELRMGGPAPGSP

SEQ ID NO: 7389 - protein, 29 aa, synthetic construct
GTAEAASASGGEAGGYPELRMGGSIPGSP

SEQ ID NO: 7390 - protein, 29 aa, synthetic construct
GTAEAASASGGPGGGYVELRMGGTAPGSP

SEQ ID NO: 7391 - protein, 29 aa, synthetic construct
GTAEAASASGGSEGGYLELRMGGAIPGSP

SEQ ID NO: 7392 - protein, 29 aa, synthetic construct
GTAEAASASGGTPGGYSELRMGGGAPGSP

SEQ ID NO: 7393 - protein, 29 aa, synthetic construct
GTAEAASASGGASGGYTELRMGGEIPGSP

SEQ ID NO: 7394 - protein, 29 aa, synthetic construct
GTAEAASASGGGTGGYQELRMGGPAPGSP

SEQ ID NO: 7395 - protein, 29 aa, synthetic construct
GTAEAASASGGEAGGYEELRMGGSIPGSP

SEQ ID NO: 7396 - protein, 29 aa, synthetic construct
GTAEAASASGGPGIGPAELRMGGTAPGSP

SEQ ID NO: 7397 - protein, 29 aa, synthetic construct
GTAEAASASGGSEIGAAELRMGGAIPGSP

SEQ ID NO: 7398 - protein, 29 aa, synthetic construct
GTAEAASASGGTPIGSAELRMGGGAPGSP

SEQ ID NO: 7399 - protein, 29 aa, synthetic construct
GTAEAASASGGASIGTAELRMGGEIPGSP

SEQ ID NO: 7400 - protein, 29 aa, synthetic construct
GTAEAASASGGGTIGNAELRMGGPAPGSP

SEQ ID NO: 7401 - protein, 29 aa, synthetic construct
GTAEAASASGGEAIGQAELRMGGSIPGSP

SEQ ID NO: 7402 - protein, 29 aa, synthetic construct
GTAEAASASGGPGGPYAELRMGGTAPGSP

SEQ ID NO: 7403 - protein, 29 aa, synthetic construct
GTAEAASASGGSEGAYAELRMGGAIPGSP

SEQ ID NO: 7404 - protein, 29 aa, synthetic construct
GTAEAASASGGTPGVYAELRMGGGAPGSP

SEQ ID NO: 7405 - protein, 29 aa, synthetic construct
GTAEAASASGGASGLYAELRMGGEIPGSP

SEQ ID NO: 7406 - protein, 29 aa, synthetic construct
GTAEAASASGGGTGIYAELRMGGPAPGSP

SEQ ID NO: 7407 - protein, 29 aa, synthetic construct
GTAEAASASGGEAGFYAELRMGGSIPGSP

SEQ ID NO: 7408 - protein, 29 aa, synthetic construct
GTAEAASASGGPGGYYAELRMGGTAPGSP

SEQ ID NO: 7409 - protein, 29 aa, synthetic construct
GTAEAASASGGSEGSYAELRMGGAIPGSP

SEQ ID NO: 7410 - protein, 29 aa, synthetic construct
GTAEAASASGGTPGNYAELRMGGGAPGSP

SEQ ID NO: 7411 - protein, 29 aa, synthetic construct
GTAEAASASGGASGEYAELRMGGEIPGSP

SEQ ID NO: 7412 - protein, 29 aa, synthetic construct
GTAEAASASGGGTGHYAELRMGGPAPGSP

SEQ ID NO: 7413 - protein, 29 aa, synthetic construct
GTAEAASASGGEAGGYAEARMGGSIPGSP

SEQ ID NO: 7414 - protein, 29 aa, synthetic construct
GTAEAASASGGPGGGYAEVRMGGTAPGSP

SEQ ID NO: 7415 - protein, 29 aa, synthetic construct
GTAEAASASGGSEGGYAEIRMGGAIPGSP

SEQ ID NO: 7416 - protein, 29 aa, synthetic construct
GTAEAASASGGTPGGYAEFRMGGGAPGSP

SEQ ID NO: 7417 - protein, 29 aa, synthetic construct
GTAEAASASGGASGGYAEYRMGGEIPGSP

SEQ ID NO: 7418 - protein, 29 aa, synthetic construct
GTAEAASASGGGTGGYAESRMGGPAPGSP

SEQ ID NO: 7419 - protein, 29 aa, synthetic construct
GTAEAASASGGEAGGYAETRMGGSIPGSP

SEQ ID NO: 7420 - protein, 29 aa, synthetic construct
GTAEAASASGGPGGGYAELAMGGTRPGSP

SEQ ID NO: 7421 - protein, 29 aa, synthetic construct
GTAEAASASGGSEGGYAELVMGGARPGSP

SEQ ID NO: 7422 - protein, 29 aa, synthetic construct
GTAEAASASGGTPGGYAELLMGGGRPGSP

SEQ ID NO: 7423 - protein, 29 aa, synthetic construct
GTAEAASASGGASGGYAELIMGGERPGSP

SEQ ID NO: 7424 - protein, 29 aa, synthetic construct
GTAEAASASGGGTGGYAELWMGGPRPGSP

SEQ ID NO: 7425 - protein, 29 aa, synthetic construct
GTAEAASASGGEAGGYAELSMGGSRPGSP

SEQ ID NO: 7426 - protein, 29 aa, synthetic construct
GTAEAASASGGPGGGYAELTMGGTRPGSP

SEQ ID NO: 7427 - protein, 29 aa, synthetic construct
GTAEAASASGGSEGGYAELQMGGARPGSP

SEQ ID NO: 7428 - protein, 29 aa, synthetic construct
GTAEAASASGGTPGGYAELNMGGGRPGSP

SEQ ID NO: 7429 - protein, 29 aa, synthetic construct
GTAEAASASGGASGGYAELEMGGERPGSP

SEQ ID NO: 7430 - protein, 29 aa, synthetic construct
GTAEAASASGGGTGGYAELRPGGPIPGSP

SEQ ID NO: 7431 - protein, 29 aa, synthetic construct
GTAEAASASGGEAGGYAELRAGGSAPGSP

SEQ ID NO: 7432 - protein, 29 aa, synthetic construct
GTAEAASASGGPGGGYAELRLGGTIPGSP

SEQ ID NO: 7433 - protein, 29 aa, synthetic construct
GTAEAASASGGSEGGYAELRIGGAAPGSP

SEQ ID NO: 7434 - protein, 29 aa, synthetic construct
GTAEAASASGGTPGGYAELRSGGGIPGSP

SEQ ID NO: 7435 - protein, 29 aa, synthetic construct
GTAEAASASGGASGGYAELRNGGEAPGSP

SEQ ID NO: 7436 - protein, 29 aa, synthetic construct
GTAEAASASGGGTGGYAELRQGGPIPGSP

SEQ ID NO: 7437 - protein, 29 aa, synthetic construct
GTAEAASASGGEAGGYAELRDGGSAPGSP

SEQ ID NO: 7438 - protein, 29 aa, synthetic construct
GTAEAASASGGPGGGYAELREGGTIPGSP

SEQ ID NO: 7439 - protein, 29 aa, synthetic construct
GTAEAASASGGSEGGYAELRHGGAAPGSP

SEQ ID NO: 7440 - protein, 29 aa, synthetic construct
GTAEAASASGGTPGGYAELRMPGGIPGSP

SEQ ID NO: 7441 - protein, 29 aa, synthetic construct
GTAEAASASGGASGGYAELRMAGEAPGSP

SEQ ID NO: 7442 - protein, 29 aa, synthetic construct
GTAEAASASGGGTGGYAELRMVGPIPGSP

SEQ ID NO: 7443 - protein, 29 aa, synthetic construct
GTAEAASASGGEAGGYAELRMLGSAPGSP

SEQ ID NO: 7444 - protein, 29 aa, synthetic construct
GTAEAASASGGPGGGYAELRMIGTIPGSP

SEQ ID NO: 7445 - protein, 29 aa, synthetic construct
GTAEAASASGGSEGGYAELRMYGAIPGSP

SEQ ID NO: 7446 - protein, 29 aa, synthetic construct
GTAEAASASGGTPGGYAELRMSGGAPGSP

SEQ ID NO: 7447 - protein, 29 aa, synthetic construct
GTAEAASASGGASGGYAELRMNGEIPGSP

SEQ ID NO: 7448 - protein, 29 aa, synthetic construct
GTAEAASASGGGTGGYAELRMQGPAPGSP

SEQ ID NO: 7449 - protein, 29 aa, synthetic construct
GTAEAASASGGANHTPAGLTGPGARPGSP

SEQ ID NO: 7450 - protein, 29 aa, synthetic construct
GTAEAASASGGANTAPEGLTGPSTRPGSP

SEQ ID NO: 7451 - protein, 29 aa, synthetic construct
GTAEAASASGGTGAPPGGLTGPGTRPGSP

SEQ ID NO: 7452 - protein, 29 aa, synthetic construct
GTAEAASASGGANHEPSGLTEGSPRPGSP

SEQ ID NO: 7453 - protein, 29 aa, synthetic construct
GTAEAASASGGANTEPPELGAGTERPGSP

SEQ ID NO: 7454 - protein, 29 aa, synthetic construct
GTAEAASASGGASGPPPGLTGPPGRPGSP

SEQ ID NO: 7455 - protein, 29 aa, synthetic construct
GTAEAASASGGASGTPAPLGGEPGRPGSP

SEQ ID NO: 7456 - protein, 29 aa, synthetic construct
GTAEAASASGGPAGPPEGLETEAGRPGSP

SEQ ID NO: 7457 - protein, 29 aa, synthetic construct
GTAEAASASGGPTSGQGGLTGPESRPGSP

SEQ ID NO: 7458 - protein, 29 aa, synthetic construct
GTAEAASASGGSAGGAANLVRGGAIPGSP

SEQ ID NO: 7459 - protein, 29 aa, synthetic construct
GTAEAASASGGTGGGAAPLVRGGGAPGSP

SEQ ID NO: 7460 - protein, 29 aa, synthetic construct
GTAEAASASGGAEGGAAALVRGGEIPGSP

SEQ ID NO: 7461 - protein, 29 aa, synthetic construct
GTAEAASASGGGPGGAALLVRGGPAPGSP

SEQ ID NO: 7462 - protein, 29 aa, synthetic construct
GTAEAASASGGEAGGAAFLVRGGSIPGSP

SEQ ID NO: 7463 - protein, 29 aa, synthetic construct
GTAEAASASGGPGGGAASLVRGGTAPGSP

SEQ ID NO: 7464 - protein, 29 aa, synthetic construct
GTAEAASASGGSEGGAATLVRGGAIPGSP

SEQ ID NO: 7465 - protein, 29 aa, synthetic construct
GTAEAASASGGTPGGAAGLVRGGGAPGSP

SEQ ID NO: 7466 - protein, 29 aa, synthetic construct
GTAEAASASGGASGGAADLVRGGEIPGSP

SEQ ID NO: 7467 - protein, 29 aa, synthetic construct
GTAEAASASGGGTGGAGNLVRGGPAPGSP

SEQ ID NO: 7468 - protein, 29 aa, synthetic construct
GTAEAASASGGEAGGAPNLVRGGSIPGSP

SEQ ID NO: 7469 - protein, 29 aa, synthetic construct
GTAEAASASGGPGGGAVNLVRGGTAPGSP

SEQ ID NO: 7470 - protein, 29 aa, synthetic construct
GTAEAASASGGSEGGALNLVRGGAIPGSP

SEQ ID NO: 7471 - protein, 29 aa, synthetic construct
GTAEAASASGGTPGGASNLVRGGGAPGSP

SEQ ID NO: 7472 - protein, 29 aa, synthetic construct
GTAEAASASGGASGGATNLVRGGEIPGSP

SEQ ID NO: 7473 - protein, 29 aa, synthetic construct
GTAEAASASGGGTGGAQNLVRGGPAPGSP

SEQ ID NO: 7474 - protein, 29 aa, synthetic construct
GTAEAASASGGEAGGAENLVRGGSIPGSP

SEQ ID NO: 7475 - protein, 30 aa, synthetic construct
GTAEAASASGEAGRSANHEPLGLVATPGSP

SEQ ID NO: 7476 - protein, 30 aa, synthetic construct
GTAEAASASGASGRSTNAGPSGLAGPPGSP

SEQ ID NO: 7477 - protein, 30 aa, synthetic construct
GTAEAASASGASGRSTNAGPQGLAGQPGSP

SEQ ID NO: 7478 - protein, 30 aa, synthetic construct
GTAEAASASGASGRSTNAGPPGLTGPPGSP

SEQ ID NO: 7479 - protein, 30 aa, synthetic construct
GTAEAASASGASSRGTNAGPAGLTGPPGSP

SEQ ID NO: 7480 - protein, 30 aa, synthetic construct
GTAEAASASGASSRTTNTGPSTLTGPPGSP

SEQ ID NO: 7481 - protein, 30 aa, synthetic construct
GTAEAASASGAAGRSDNGTPLELVAPPGSP

SEQ ID NO: 7482 - protein, 30 aa, synthetic construct; identical to SEQ ID NO: 7475

SEQ ID NO: 7483 - protein, 30 aa, synthetic construct
GTAEAASASGASGRGTNAGPAGLTGPPGSP

SEQ ID NO: 7484 - protein, 30 aa, synthetic construct
GTAEAASASGLFGRNDNHEPLELGGGPGSP

SEQ ID NO: 7485 - protein, 30 aa, synthetic construct
GTAEAASASGTAGRSDNLEPLGLVFGPGSP

SEQ ID NO: 7486 - protein, 30 aa, synthetic construct
GTAEAASASGLDGRSDNFHPPELVAGPGSP

SEQ ID NO: 7487 - protein, 30 aa, synthetic construct
GTAEAASASGLEGRSDNEEPENLVAGPGSP

SEQ ID NO: 7488 - protein, 30 aa, synthetic construct
GTAEAASASGLKGRSDNNAPLALVAGPGSP

SEQ ID NO: 7489 - protein, 30 aa, synthetic construct
GTAEAASASGVYSRGTNAGPHGLTGRPGSP

SEQ ID NO: 7490 - protein, 30 aa, synthetic construct
GTAEAASASGANSRGTNKGFAGLIGPPGSP

SEQ ID NO: 7491 - protein, 30 aa, synthetic construct
GTAEAASASGASSRLTNEAPAGLTIPPGSP

SEQ ID NO: 7492 - protein, 30 aa, synthetic construct
GTAEAASASGDQSRGTNAGPEGLTDPPGSP

SEQ ID NO: 7493 - protein, 30 aa, synthetic construct
GTAEAASASGESSRGTNIGQGGLTGPPGSP

SEQ ID NO: 7494 - protein, 30 aa, synthetic construct
GTAEAASASGSSSRGTNQDPAGLTIPPGSP

SEQ ID NO: 7495 - protein, 30 aa, synthetic construct
GTAEAASASGASSRGQNHSPMGLTGPPGSP

SEQ ID NO: 7496 - protein, 30 aa, synthetic construct
GTAEAASASGAYSRGPNAGPAGLEGRPGSP

SEQ ID NO: 7497 - protein, 30 aa, synthetic construct
GTAEAASASGASERGNNAGPANLTGFPGSP

SEQ ID NO: 7498 - protein, 30 aa, synthetic construct
GTAEAASASGASHRGTNPKPAILTGPPGSP

SEQ ID NO: 7499 - protein, 30 aa, synthetic construct
GTAEAASASGMSSRRTNANPAQLTGPPGSP

SEQ ID NO: 7500 - protein, 30 aa, synthetic construct
GTAEAASASGGAGRTDNHEPLELGAAPGSP

SEQ ID NO: 7501 - protein, 30 aa, synthetic construct
GTAEAASASGLAGRSENTAPLELTAGPGSP

SEQ ID NO: 7502 - protein, 30 aa, synthetic construct
GTAEAASASGLEGRPDNHEPLALVASPGSP

SEQ ID NO: 7503 - protein, 30 aa, synthetic construct
GTAEAASASGLSGRSDNEEPLALPAGPGSP

SEQ ID NO: 7504 - protein, 30 aa, synthetic construct
GTAEAASASGEAGRTDNHEPLELSAPPGSP

SEQ ID NO: 7505 - protein, 30 aa, synthetic construct
GTAEAASASGEGGRSDNHGPLELVSGPGSP

SEQ ID NO: 7506 - protein, 30 aa, synthetic construct
GTAEAASASGLSGRSDNEAPLELEAGPGSP

SEQ ID NO: 7507 - protein, 30 aa, synthetic construct
GTAEAASASGLGGRADNHEPPELGAGPGSP

SEQ ID NO: 7508 - protein, 30 aa, synthetic construct
GTAEAASASGPPSRGTNAEPAGLTGEPGSP

SEQ ID NO: 7509 - protein, 30 aa, synthetic construct
GTAEAASASGASTRGENAGPAGLEAPPGSP

SEQ ID NO: 7510 - protein, 30 aa, synthetic construct
GTAEAASASGESSRGTNGAPEGLTGPPGSP

SEQ ID NO: 7511 - protein, 30 aa, synthetic construct
GTAEAASASGASSRATNESPAGLTGEPGSP

SEQ ID NO: 7512 - protein, 30 aa, synthetic construct
GTAEAASASGASSRGENPPPGGLTGPPGSP

SEQ ID NO: 7513 - protein, 30 aa, synthetic construct
GTAEAASASGAASRGTNTGPAELTGSPGSP

SEQ ID NO: 7514 - protein, 30 aa, synthetic construct
GTAEAASASGAGSRTTNAGPGGLEGPPGSP

SEQ ID NO: 7515 - protein, 30 aa, synthetic construct
GTAEAASASGAPSRGENAGPATLTGAPGSP

SEQ ID NO: 7516 - protein, 30 aa, synthetic construct
GTAEAASASGESGRAANTGPPTLTAPPGSP

SEQ ID NO: 7517 - protein, 30 aa, synthetic construct
GTAEAASASGNPGRAANEGPPGLPGSPGSP

SEQ ID NO: 7518 - protein, 30 aa, synthetic construct
GTAEAASASGESSRAANLTPPELTGPPGSP

SEQ ID NO: 7519 - protein, 30 aa, synthetic construct
GTAEAASASGASGRAANETPPGLTGAPGSP

SEQ ID NO: 7520 - protein, 30 aa, synthetic construct
GTAEAASASGNSGRGENLGAPGLTGTPGSP

SEQ ID NO: 7521 - protein, 30 aa, synthetic construct
GTAEAASASGTTGRAANLTPAGLTGPPGSP

SEQ ID NO: 7522 - protein, 30 aa, synthetic construct
GTAEAASASGEAGRSANHTPAGLTGPPGSP

SEQ ID NO: 7523 - protein, 30 aa, synthetic construct
GTAEAASASGESGRAANTTPAGLTGPPGSP

SEQ ID NO: 7524 - protein, 33 aa, synthetic construct
GTAEAASASGTTGRATEAANLTPAGLTGPPGSP

SEQ ID NO: 7525 - protein, 33 aa, synthetic construct
GTAEAASASGTTGRAEEAANLTPAGLTGPPGSP

SEQ ID NO: 7526 - protein, 33 aa, synthetic construct
GTAEAASASGTTGRAGEAANLTPAGLTGPPGSP

SEQ ID NO: 7527 - protein, 33 aa, synthetic construct
GTAEAASASGTTGRATEAANATPAGLTGPPGSP

SEQ ID NO: 7528 - protein, 33 aa, synthetic construct
GTAEAASASGTTGRAGEAEGATSAGATGPPGSP

SEQ ID NO: 7529 - protein, 33 aa, synthetic construct
GTAEAASASGTTGEAGEAANATSAGATGPPGSP

SEQ ID NO: 7530 - protein, 33 aa, synthetic construct
GTAEAASASGTTGEAGEAAGLTPAGLTGPPGSP

SEQ ID NO: 7531 - protein, 33 aa, synthetic construct
GTAEAASASGTTGAAGEAANATPAGLTGPPGSP

SEQ ID NO: 7532 - protein, 33 aa, synthetic construct
GTAEAASASGTTGRAGEAAGLTPAGLTGPPGSP

SEQ ID NO: 7533 - protein, 33 aa, synthetic construct
GTAEAASASGTTGRAGEAANATSAGATGPPGSP

SEQ ID NO: 7534 - protein, 33 aa, synthetic construct
GTAEAASASGTTGEAGEAAGATSAGATGPPGSP

SEQ ID NO: 7535 - protein, 30 aa, synthetic construct
GTAEAASASGESGRAANTEPPELGAGPGSP

SEQ ID NO: 7536 - protein, 30 aa, synthetic construct
GTAEAASASGESGRAANTAPEGLTGPPGSP

SEQ ID NO: 7537 - protein, 30 aa, synthetic construct
GTAEAASASGEPGRAANHEPSGLTEGPGSP

SEQ ID NO: 7538 - protein, 33 aa, synthetic construct
GTAEAASASGESGRAANHTGAPPGGLTGPPGSP

SEQ ID NO: 7539 - protein, 33 aa, synthetic construct
GTAEAASASGTTGRTGEGANATPGGLTGPPGSP

SEQ ID NO: 7540 - protein, 33 aa, synthetic construct
GTAEAASASGRTGRSGEAANETPEGLEGPPGSP

SEQ ID NO: 7541 - protein, 33 aa, synthetic construct
GTAEAASASGRTGRTGESANETPAGLGGPPGSP

SEQ ID NO: 7542 - protein, 33 aa, synthetic construct
GTAEAASASGSTGRTGEPANETPAGLSGPPGSP

SEQ ID NO: 7543 - protein, 33 aa, synthetic construct
GTAEAASASGTTGRAGEPANATPTGLSGPPGSP

SEQ ID NO: 7544 - protein, 33 aa, synthetic construct
GTAEAASASGRTGRPGEGANATPTGLPGPPGSP

SEQ ID NO: 7545 - protein, 33 aa, synthetic construct
GTAEAASASGRTGRGGEAANATPSGLGGPPGSP

SEQ ID NO: 7546 - protein, 33 aa, synthetic construct
GTAEAASASGSTGRSGESANATPGGLGGPPGSP

SEQ ID NO: 7547 - protein, 33 aa, synthetic construct
GTAEAASASGRTGRTGEEANATPAGLPGPPGSP

SEQ ID NO: 7548 - protein, 33 aa, synthetic construct
GTAEAASASGATGRPGEPANTTPEGLEGPPGSP

SEQ ID NO: 7549 - protein, 33 aa, synthetic construct
GTAEAASASGSTGRSGEPANATPGGLTGPPGSP

SEQ ID NO: 7550 - protein, 33 aa, synthetic construct
GTAEAASASGPTGRGGEGANTTPTGLPGPPGSP

SEQ ID NO: 7551 - protein, 33 aa, synthetic construct
GTAEAASASGPTGRSGEGANATPSGLTGPPGSP

SEQ ID NO: 7552 - protein, 33 aa, synthetic construct
GTAEAASASGTTGRASEGANSTPAPLTEPPGSP

SEQ ID NO: 7553 - protein, 33 aa, synthetic construct
GTAEAASASGTYGRAAEAANTTPAGLTAPPGSP

SEQ ID NO: 7554 - protein, 33 aa, synthetic construct
GTAEAASASGTTGRATEGANATPAELTEPPGSP

SEQ ID NO: 7555 - protein, 33 aa, synthetic construct
GTAEAASASGTVGRASEEANTTPASLTGPPGSP

SEQ ID NO: 7556 - protein, 33 aa, synthetic construct
GTAEAASASGTTGRAPEAANATPAPLTGPPGSP

SEQ ID NO: 7557 - protein, 33 aa, synthetic construct
GTAEAASASGTWGRATEPANATPAPLTSPPGSP

SEQ ID NO: 7558 - protein, 33 aa, synthetic construct
GTAEAASASGTVGRASESANATPAELTSPPGSP

SEQ ID NO: 7559 - protein, 33 aa, synthetic construct
GTAEAASASGTVGRAPEGANSTPAGLTGPPGSP

SEQ ID NO: 7560 - protein, 33 aa, synthetic construct
GTAEAASASGTWGRATEAPNLEPATLTTPPGSP

SEQ ID NO: 7561 - protein, 33 aa, synthetic construct
GTAEAASASGTTGRATEAPNLTPAPLTEPPGSP

SEQ ID NO: 7562 - protein, 33 aa, synthetic construct
GTAEAASASGTQGRATEAPNLSPAALTSPPGSP

SEQ ID NO: 7563 - protein, 33 aa, synthetic construct
GTAEAASASGTQGRAAEAPNLTPATLTAPPGSP

SEQ ID NO: 7564 - protein, 33 aa, synthetic construct
GTAEAASASGTSGRAPEATNLAPAPLTGPPGSP

SEQ ID NO: 7565 - protein, 33 aa, synthetic construct
GTAEAASASGTQGRAAEAANLTPAGLTEPPGSP

SEQ ID NO: 7566 - protein, 33 aa, synthetic construct
GTAEAASASGTTGRAGSAPNLPPTGLTTPPGSP

SEQ ID NO: 7567 - protein, 33 aa, synthetic construct
GTAEAASASGTTGRAGGAENLPPEGLTAPPGSP

SEQ ID NO: 7568 - protein, 33 aa, synthetic construct
GTAEAASASGTTSRAGTATNLTPEGLTAPPGSP

SEQ ID NO: 7569 - protein, 33 aa, synthetic construct
GTAEAASASGTTGRAGTATNLPPSGLTTPPGSP

SEQ ID NO: 7570 - protein, 33 aa, synthetic construct
GTAEAASASGTTARAGEAENLSPSGLTAPPGSP

SEQ ID NO: 7571 - protein, 33 aa, synthetic construct
GTAEAASASGTTGRAGGAGNLAPGGLTEPPGSP

SEQ ID NO: 7572 - protein, 33 aa, synthetic construct
GTAEAASASGTTGRAGTATNLPPEGLTGPPGSP

SEQ ID NO: 7573 - protein, 33 aa, synthetic construct
GTAEAASASGTTGRAGGAANLAPTGLTEPPGSP

SEQ ID NO: 7574 - protein, 33 aa, synthetic construct
GTAEAASASGTTGRAGTAENLAPSGLTTPPGSP

SEQ ID NO: 7575 - protein, 33 aa, synthetic construct
GTAEAASASGTTGRAGSATNLGPGGLTGPPGSP

SEQ ID NO: 7576 - protein, 33 aa, synthetic construct
GTAEAASASGTTARAGGAENLTPAGLTEPPGSP

SEQ ID NO: 7577 - protein, 33 aa, synthetic construct
GTAEAASASGTTARAGSAENLSPSGLTGPPGSP

SEQ ID NO: 7578 - protein, 33 aa, synthetic construct
GTAEAASASGTTARAGGAGNLAPEGLTTPPGSP

SEQ ID NO: 7579 - protein, 33 aa, synthetic construct
GTAEAASASGTTSRAGAAENLTPTGLTGPPGSP

SEQ ID NO: 7580 - protein, 33 aa, synthetic construct
GTAEAASASGTYGRTTTPGNEPPASLEAEPGSP

SEQ ID NO: 7581 - protein, 33 aa, synthetic construct
GTAEAASASGTYSRGESGPNEPPPGLTGPPGSP

SEQ ID NO: 7582 - protein, 33 aa, synthetic construct
GTAEAASASGAWGRTGASENETPAPLGGEPGSP

SEQ ID NO: 7583 - protein, 33 aa, synthetic construct
GTAEAASASGRWGRAETTPNTPPEGLETEPGSP

SEQ ID NO: 7584 - protein, 33 aa, synthetic construct
GTAEAASASGESGRAANHTGAEPPELGAGPGSP

SEQ ID NO: 7585 - protein, 33 aa, synthetic construct
GTAEAASASGTTGRAGEAANLTPAGLTESPGSP

SEQ ID NO: 7586 - protein, 33 aa, synthetic construct
GTAEAASASGTTGRAGEAANLTPAALTESPGSP

SEQ ID NO: 7587 - protein, 33 aa, synthetic construct
GTAEAASASGTTGRAGEAANLTPAPLTESPGSP

SEQ ID NO: 7588 - protein, 33 aa, synthetic construct
GTAEAASASGTTGRAGEAANLTPEPLTESPGSP

SEQ ID NO: 7589 - protein, 33 aa, synthetic construct
GTAEAASASGTTGRAGEAANLTPAGLTGAPGSP

SEQ ID NO: 7590 - protein, 33 aa, synthetic construct
GTAEAASASGTTGRAGEAANLTPEGLTGAPGSP

SEQ ID NO: 7591 - protein, 33 aa, synthetic construct
GTAEAASASGTTGRAGEAANLTPEPLTGAPGSP

SEQ ID NO: 7592 - protein, 33 aa, synthetic construct
GTAEAASASGTTGRAGEAANLTPAGLTEAPGSP

SEQ ID NO: 7593 - protein, 33 aa, synthetic construct
GTAEAASASGTTGRAGEAANLTPEGLTEAPGSP

SEQ ID NO: 7594 - protein, 33 aa, synthetic construct
GTAEAASASGTTGRAGEAANLTPAPLTEAPGSP

SEQ ID NO: 7595 - protein, 33 aa, synthetic construct
GTAEAASASGTTGRAGEAANLTPEPLTEAPGSP

SEQ ID NO: 7596 - protein, 33 aa, synthetic construct
GTAEAASASGTTGRAGEAANLTPEPLTGPPGSP

SEQ ID NO: 7597 - protein, 33 aa, synthetic construct
GTAEAASASGTTGRAGEAANLTPAGLTGGPGSP

SEQ ID NO: 7598 - protein, 33 aa, synthetic construct
GTAEAASASGTTGRAGEAANLTPEGLTGGPGSP

SEQ ID NO: 7599 - protein, 33 aa, synthetic construct
GTAEAASASGTTGRAGEAANLTPEALTGGPGSP

SEQ ID NO: 7600 - protein, 33 aa, synthetic construct
GTAEAASASGTTGRAGEAANLTPEPLTGGPGSP

SEQ ID NO: 7601 - protein, 33 aa, synthetic construct
GTAEAASASGTTGRAGEAANLTPAGLTEGPGSP

SEQ ID NO: 7602 - protein, 33 aa, synthetic construct
GTAEAASASGTTGRAGEAANLTPEGLTEGPGSP

SEQ ID NO: 7603 - protein, 33 aa, synthetic construct
GTAEAASASGTTGRAGEAANLTPAPLTEGPGSP

SEQ ID NO: 7604 - protein, 33 aa, synthetic construct
GTAEAASASGTTGRAGEAANLTPEPLTEGPGSP

SEQ ID NO: 7605 - protein, 33 aa, synthetic construct; identical to SEQ ID NO: 7528

SEQ ID NO: 7606 - protein, 30 aa, synthetic construct
GTAEAASASGEAGRSAEATSAGATGPPGSP

SEQ ID NO: 7607 - protein, 30 aa, synthetic construct
GTAEAASASGSASGTYSRGESGPGSPPGSP

SEQ ID NO: 7608 - protein, 30 aa, synthetic construct
GTAEAASASGSASGEAGRTDTHPGSPPGSP

SEQ ID NO: 7609 - protein, 30 aa, synthetic construct
GTAEAASASGSASGEPGRAAEHPGSPPGSP

SEQ ID NO: 7610 - protein, 30 aa, synthetic construct
GTAEAASASGSPAGESSRGTTIAGSPPGSP

SEQ ID NO: 7611 - protein, 33 aa, synthetic construct; identical to SEQ ID NO: 7530

SEQ ID NO: 7612 - protein, 30 aa, synthetic construct
GTAEAASASGEAGESAGATPAGLTGPPGSP

SEQ ID NO: 7613 - protein, 30 aa, synthetic construct
GTAEAASASGSASGAPLELEAGPGSPPGSP

SEQ ID NO: 7614 - protein, 30 aa, synthetic construct
GTAEAASASGSASGEPPELGAGPGSPPGSP

SEQ ID NO: 7615 - protein, 30 aa, synthetic construct
GTAEAASASGSASGEPSGLTEGPGSPPGSP

SEQ ID NO: 7616 - protein, 30 aa, synthetic construct
GTAEAASASGSASGTPAPLTEPPGSPPGSP

SEQ ID NO: 7617 - protein, 30 aa, synthetic construct
GTAEAASASGSASGTPAELTEPPGSPPGSP

SEQ ID NO: 7618 - protein, 30 aa, synthetic construct
GTAEAASASGSASGPPPGLTGPPGSPPGSP

SEQ ID NO: 7619 - protein, 30 aa, synthetic construct
GTAEAASASGSASGTPAPLGGEPGSPPGSP

SEQ ID NO: 7620 - protein, 30 aa, synthetic construct
GTAEAASASGSPAGAPEGLTGPAGSPPGSP

SEQ ID NO: 7621 - protein, 30 aa, synthetic construct
GTAEAASASGSPAGPPEGLETEAGSPPGSP

SEQ ID NO: 7622 - protein, 30 aa, synthetic construct
GTAEAASASGSPTSGQGGLTGPGSEPPGSP

SEQ ID NO: 7623 - protein, 30 aa, synthetic construct
GTAEAASASGSESAPPEGLETESTEPPGSP

SEQ ID NO: 7624 - protein, 30 aa, synthetic construct
GTAEAASASGSEGSEPLELGAASETPPGSP

SEQ ID NO: 7625 - protein, 30 aa, synthetic construct
GTAEAASASGSEGSGPAGLEAPSETPPGSP

SEQ ID NO: 7626 - protein, 30 aa, synthetic construct
GTAEAASASGSEPTPPASLEAEPGSPPGSP

SEQ ID NO: 7627 - protein, 16 aa, synthetic construct
  VARIANT 7: note = X is any amino acid other than N
EAGRSAXHTPAGLTGP

SEQ ID NO: 7628 - protein, 16 aa, synthetic construct
EAGRSASHTPAGLTGP

SEQ ID NO: 7629-8000 - skipped (372 entries)

SEQ ID NO: 8001 - protein, 874 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8002 - protein, 870 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGPTESGSEPATSGSETPGSPAGSPTSTEEGTSTEPSEGSAPGTSTEPSEGSAPGSEPATSGSETPGTSESATPESGPGTSTEPSEGSAPGEPEA

SEQ ID NO: 8003 - protein, 870 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8004 - protein, 294 aa, synthetic construct
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8005 - protein, 294 aa, synthetic construct
ASSPAGSPTSTESGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8006 - protein, 294 aa, synthetic construct
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8007 - protein, 294 aa, synthetic construct
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8008 - protein, 866 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8009 - protein, 578 aa, synthetic construct
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8010 - protein, 1152 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESAS

SEQ ID NO: 8011 - protein, 1153 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 8012 - protein, 864 aa, synthetic construct
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8013 - protein, 864 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8014 - protein, 292 aa, synthetic construct
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8015 - protein, 582 aa, synthetic construct
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8016 - protein, 576 aa, synthetic construct
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 8017 - protein, 576 aa, synthetic construct
GTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESASPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGP

SEQ ID NO: 8018 - protein, 576 aa, synthetic construct
GSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 8019 - protein, 576 aa, synthetic construct
EGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 8020 - protein, 294 aa, synthetic construct; identical to SEQ ID NO: 8007

SEQ ID NO: 8021 - protein, 294 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATP

SEQ ID NO: 8022 - protein, 582 aa, synthetic construct
ATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 8023-8999 - skipped (977 entries)

SEQ ID NO: 9000 - DNA, 3981 bp, synthetic construct
  source 1..3981: mol_type = other DNA
gcatcttcggcgacgccggaaagcggtccgggtacgtccaccgaaccgagcgagggtagcgctccgggcaccagcgagtccgcgaccccggaaagcggtccgggtagcggtccgggcacctccgagagcgcgaccccgggcacctctgaatcagccaccccggagtctggcccaggtagcgagccggcaacctctggcagcgaaaccccgggcaccagcgaatccgcgacgccagagagcggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagccctaccagcactgaagagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggttcagaaccagctacgtctgggagcgagaccccgggcacctccgagtcggcgaccccggaggcaggtcgttctgctagccatacccctgcagggttaactggccccggaacttcagaaagtgctacacccgagtctcaggttcaactggtggagagcggtggcggtgtggttcagccgggtcgtagcctgcgtctgagctgcgcggcgagcggtcgtacctttggtatctatgtgtggggttggtttcgtcaggcgccgggcaaggagcgtgaattcgtgggcgcgatgagctggagcggtagcaaccgtaaagtgagcgacagcgttaagggccgttttaccattagccgtgataacagcaaaaacaccctgtacctgcaaatgaacagcctgcgtgcggaggacaccgcggtttactattgcgcggcgagcaacaaagaatatggccgtacctggtatgatttcaatgagagcgactactggggccaaggcacccaagtgaccgttagcagcgggggaggcggaagtggtggagggtcagagttagttgtgacccaagagccgagcctgaccgttagcccgggtggtacggtcaccctgacgtgccgtagcagcaacggtgcggtcacgagcagcaactatgccaattgggtccagcagaaaccgggtcaagcaccgcgtggcctgatcggcggcaccaataaacgtgccccgggtactcctgcgcgtttctccggtagcctgctgggcggcaaagccgctctgaccctgagcggtgtccagccggaagatgaagcggtgtactactgcgcgctgtggtatccgaatctgtgggtttttggcggcggtaccaagctgaccgtattgagcgagagcgcaacgccagagagcggtccaggcaccagcccaggtgccacccctgagagcggcccaggtacttctgagagcgccactccggaggtccaactggtggagtctggtggtggcattgttcaaccgggtggctcgttgcgcctgagctgtgcagctagcggctttaccttcagcacctatgcgatgaattgggttcgtcaggcaccgggtaagggcctggaatgggtgggccgtatccgcaccaagcgcaacaactacgcgacctactacgcggatagcgttaaaggccgcttcacgattagccgtgacgattccaagaatacggtgtatctgcaaatgaacagcctgaaaaccgaagataccgcggtgtattactgtgtgcgccacgaaaatttcggcaacagctacgtgagctggtttgcacattggggtcagggcaccctggttacggtgagctccggtacagctactccagaatcaggacccggggaagctggaagaagcgcctcacacacaccagctggacttacaggcccggctactcccgaaagtgggccaggaacatcagagtccgcgaccccggaaagcggtccgggttctccagctggcagcccgacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttcaccctctgctacgccggaaagcggtccgggttccgagccggcgaccagcggctccgagactccgggttcggagccggcgacctccggctcggaaaccccgggtagcccggctggttctccgaccagcactgaggaaggcaccagcaccgaaccaagcgagggcagcgcgccaggtacgagcaccgaaccgagcgagggttcagcccctggctctgagccggcgacgtctggctccgaaaccccgggcaccagcgagagcgctggtgaaccggaagcg

SEQ ID NO: 9001 - protein, 109 aa, synthetic construct
  VARIANT 26: note = X can be T or N
  VARIANT 31: note = X can be T or S
  VARIANT 95: note = X can be S or P
  VARIANT 87: note = X can be E or V
ELVVTQEPSLTVSPGGTVTLTCRSSXGAVTXSNYANWVQQKPGQAPRGLIGGTNKRAPGTPARFSGSLLGGKAALTLSGVQPEDEAXYYCALWYXNLWVFGGGTKLTVL

SEQ ID NO: 9002 - protein, 125 aa, synthetic construct
  VARIANT 5: note = X can be V or L
  VARIANT 19: note = X can be R or K
  VARIANT 30: note = X can be S or N
  VARIANT 49: note = X can be G or A
  VARIANT 53: note = X can be T or S
  VARIANT 55: note = X can be R or Y
  VARIANT 68: note = X can be G or D
  VARIANT 81: note = X can be V or A
  VARIANT 87: note = X can be S or N
  VARIANT 102: note = X can be E or G
  VARIANT 114: note = X can be H or Y
EVQLXESGGGJVQPGGSLXLSCAASGFTFXTYAMNWVRQAPGKGLEWVXRIRXKXNNYATYYADSVKXRFTISRDDSKNTXYLQMNXLKTEDTAVYYCVRHXNFGNSYVSWFAXWGQGTLVTVSS

SEQ ID NO: 9003 - protein, 10 aa, synthetic construct
GRTFGIYVWG

SEQ ID NO: 9004 - protein, 17 aa, synthetic construct
AMSWSGSNRKVSDSVKG

SEQ ID NO: 9005 - protein, 19 aa, synthetic construct
AASNKEYGRTWYDFNESDY

SEQ ID NO: 9006 - protein, 14 aa, synthetic construct
  VARIANT 4: note = X can be T or N
  VARIANT 9: note = X can be T or S
RSSXGAVTXSNYAN

SEQ ID NO: 9007 - protein, 9 aa, synthetic construct
  VARIANT 5: note = X can be S or P
ALWYXNLWV

SEQ ID NO: 9008 - protein, 10 aa, synthetic construct
  VARIANT 5: note = X can be S or N
GFTFXTYAMN

SEQ ID NO: 9009 - protein, 19 aa, synthetic construct
  VARIANT 4: note = X can be T or S
  VARIANT 6: note = X can be R or Y
  VARIANT 19: note = X can be G or D
RIRXKXNNYATYYADSVKX

SEQ ID NO: 9010 - protein, 14 aa, synthetic construct
  VARIANT 2: note = X can be E or G
  VARIANT 14: note = X can be H or Y
HXNFGNSYVSWFAX

SEQ ID NO: 9011 - protein, 25 aa, synthetic construct
QVQLVESGGGVVQPGRSLRLSCAAS

SEQ ID NO: 9012 - protein, 14 aa, synthetic construct
WFRQAPGKEREFVG

SEQ ID NO: 9013 - protein, 30 aa, synthetic construct
RFTISRDNSKNTLYLQMNSLRAEDTAVYYC

SEQ ID NO: 9014 - protein, 11 aa, synthetic construct
WGQGTQVTVSS

SEQ ID NO: 9015 - protein, 10 aa, synthetic construct
AMSWSGSNRK

SEQ ID NO: 9016 - protein, 37 aa, synthetic construct
VSDSVKGRFTISRDNSKNTLYLQMNSLRAEDTAVYYC

SEQ ID NO: 9017 - protein, 126 aa, synthetic construct
  VARIANT 34: note = X can be M or W
  VARIANT 51: note = X can be M or I
  VARIANT 95: note = X can be F or Y
  VARIANT 97..98: note = X can be A or G
  VARIANT 102: note = X can be L, W, R, D, E, or G
QVQLVESGGGVVQPGRSLRLSCAASGRTFGIYVXGWFRQAPGKEREFVGAXSWSGSNRKVSDSVKGRFTISRDNSKNTLYLQMNSLRAEDTAVYXCXXSNKXYGRTWYDFNESDYWGQGTQVTVSS

SEQ ID NO: 9018 - protein, 12 aa, synthetic construct
GSGPGTSESATP

SEQ ID NO: 9019 - protein, 12 aa, synthetic construct
GTSPSATPESGP

SEQ ID NO: 9020 - protein, 8 aa, synthetic construct
ATPESGPG

SEQ ID NO: 9021 - protein, 8 aa, synthetic construct
SGSETPGT

SEQ ID NO: 9022 - protein, 8 aa, synthetic construct
GTSESATP

SEQ ID NO: 9023 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXSGPESGPG

SEQ ID NO: 9024 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXATPESGPG

SEQ ID NO: 9025 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTSESATP

SEQ ID NO: 9026 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXTTPESGPG

SEQ ID NO: 9027 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXSTPESGPG

SEQ ID NO: 9028 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTPESGPG

SEQ ID NO: 9029 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTPETPGS

SEQ ID NO: 9030 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXSGSETGTP

SEQ ID NO: 9031 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTPEGSAP

SEQ ID NO: 9032 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXEPSESATP

SEQ ID NO: 9033 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXSGPESGPG

SEQ ID NO: 9034 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXATPESGPG

SEQ ID NO: 9035 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTSESATP

SEQ ID NO: 9036 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXTTPESGPG

SEQ ID NO: 9037 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXSTPESGPG

SEQ ID NO: 9038 - protein, 46 aa, synthetic construct
  VARIANT 9..38: note = Up to 30 X residues may be deleted
  VARIANT 9..38: note = X can be any amino acid
SGPESGPGXXXXXXXXXXXXXXXXXXXXXXXXXXXXXXATPESGPG

SEQ ID NO: 9039 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXATPESGPG

SEQ ID NO: 9040 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXGTSESATP

SEQ ID NO: 9041 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXTTPESGPG

SEQ ID NO: 9042 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXSTPESGPG

SEQ ID NO: 9043 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTPESGPG

SEQ ID NO: 9044 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXGTPESGPG

SEQ ID NO: 9045 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTPETPGS

SEQ ID NO: 9046 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXSGSETGTP

SEQ ID NO: 9047 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTPEGSAP

SEQ ID NO: 9048 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXEPSESATP

SEQ ID NO: 9049 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXSGPESGPG

SEQ ID NO: 9050 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXATPESGPG

SEQ ID NO: 9051 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTSESATP

SEQ ID NO: 9052 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXTTPESGPG

SEQ ID NO: 9053 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXSTPESGPG

SEQ ID NO: 9054 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTPESGPG

SEQ ID NO: 9055 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTPETPGS

SEQ ID NO: 9056 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXSGSETGTP

SEQ ID NO: 9057 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTPEGSAP

SEQ ID NO: 9058 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXEPSESATP

SEQ ID NO: 9059 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXSGPESGPG

SEQ ID NO: 9060 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXATPESGPG

SEQ ID NO: 9061 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTSESATP

SEQ ID NO: 9062 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXTTPESGPG

SEQ ID NO: 9063 - protein, 46 aa, synthetic construct
  VARIANT 9..38: note = Up to 30 X residues may be deleted
  VARIANT 9..38: note = X can be any amino acid
TTPESGPGXXXXXXXXXXXXXXXXXXXXXXXXXXXXXXTTPESGPG

SEQ ID NO: 9064 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXSTPESGPG

SEQ ID NO: 9065 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTPESGPG

SEQ ID NO: 9066 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTPETPGS

SEQ ID NO: 9067 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXSGSETGTP

SEQ ID NO: 9068 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTPEGSAP

SEQ ID NO: 9069 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXEPSESATP

SEQ ID NO: 9070 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXSGPESGPG

SEQ ID NO: 9071 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXATPESGPG

SEQ ID NO: 9072 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTSESATP

SEQ ID NO: 9073 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXTTPESGPG

SEQ ID NO: 9074 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXSTPESGPG

SEQ ID NO: 9075 - protein, 46 aa, synthetic construct
  VARIANT 9..38: note = Up to 30 X residues may be deleted
  VARIANT 9..38: note = X can be any amino acid
STPESGPGXXXXXXXXXXXXXXXXXXXXXXXXXXXXXXSTPESGPG

SEQ ID NO: 9076 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTPESGPG

SEQ ID NO: 9077 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTPETPGS

SEQ ID NO: 9078 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXSGSETGTP

SEQ ID NO: 9079 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTPEGSAP

SEQ ID NO: 9080 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXEPSESATP

SEQ ID NO: 9081 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXSGPESGPG

SEQ ID NO: 9082 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXATPESGPG

SEQ ID NO: 9083 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTSESATP

SEQ ID NO: 9084 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXTTPESGPG

SEQ ID NO: 9085 - protein, 46 aa, synthetic construct
  VARIANT 9..38: note = Up to 30 X residues may be deleted
  VARIANT 9..38: note = X can be any amino acid
GTPESGPGXXXXXXXXXXXXXXXXXXXXXXXXXXXXXXTTPESGPG

SEQ ID NO: 9086 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXSTPESGPG

SEQ ID NO: 9087 - protein, 46 aa, synthetic construct
  VARIANT 9..38: note = Up to 30 X residues may be deleted
  VARIANT 9..38: note = X can be any amino acid
GTPESGPGXXXXXXXXXXXXXXXXXXXXXXXXXXXXXXSTPESGPG

SEQ ID NO: 9088 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTPESGPG

SEQ ID NO: 9089 - protein, 46 aa, synthetic construct
  VARIANT 9..38: note = Up to 30 X residues may be deleted
  VARIANT 9..38: note = X can be any amino acid
GTPESGPGXXXXXXXXXXXXXXXXXXXXXXXXXXXXXXGTPESGPG

SEQ ID NO: 9090 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTPETPGS

SEQ ID NO: 9091 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXSGSETGTP

SEQ ID NO: 9092 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTPEGSAP

SEQ ID NO: 9093 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXEPSESATP

SEQ ID NO: 9094 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXSGPESGPG

SEQ ID NO: 9095 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXATPESGPG

SEQ ID NO: 9096 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTSESATP

SEQ ID NO: 9097 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXTTPESGPG

SEQ ID NO: 9098 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXSTPESGPG

SEQ ID NO: 9099 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTPESGPG

SEQ ID NO: 9100 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTPETPGS

SEQ ID NO: 9101 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXSGSETGTP

SEQ ID NO: 9102 - protein, 46 aa, synthetic construct
  VARIANT 9..38: note = Up to 30 X residues may be deleted
  VARIANT 9..38: note = X can be any amino acid
GTPETPGSXXXXXXXXXXXXXXXXXXXXXXXXXXXXXXSGSETGTP

SEQ ID NO: 9103 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTPEGSAP

SEQ ID NO: 9104 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXEPSESATP

SEQ ID NO: 9105 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXSGPESGPG

SEQ ID NO: 9106 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXATPESGPG

SEQ ID NO: 9107 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTSESATP

SEQ ID NO: 9108 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXTTPESGPG

SEQ ID NO: 9109 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXSTPESGPG

SEQ ID NO: 9110 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTPESGPG

SEQ ID NO: 9111 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTPETPGS

SEQ ID NO: 9112 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXSGSETGTP

SEQ ID NO: 9113 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTPEGSAP

SEQ ID NO: 9114 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXEPSESATP

SEQ ID NO: 9115 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXSGPESGPG

SEQ ID NO: 9116 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXATPESGPG

SEQ ID NO: 9117 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTSESATP

SEQ ID NO: 9118 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXTTPESGPG

SEQ ID NO: 9119 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXSTPESGPG

SEQ ID NO: 9120 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTPESGPG

SEQ ID NO: 9121 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTPETPGS

SEQ ID NO: 9122 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXSGSETGTP

SEQ ID NO: 9123 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTPEGSAP

SEQ ID NO: 9124 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXEPSESATP

SEQ ID NO: 9125 - protein, 46 aa, synthetic construct
  VARIANT 9..38: note = Up to 30 X residues may be deleted
  VARIANT 9..38: note = X can be any amino acid
GTPEGSAPXXXXXXXXXXXXXXXXXXXXXXXXXXXXXXEPSESATP

SEQ ID NO: 9126 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXSGPESGPG

SEQ ID NO: 9127 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXATPESGPG

SEQ ID NO: 9128 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTSESATP

SEQ ID NO: 9129 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXTTPESGPG

SEQ ID NO: 9130 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXSTPESGPG

SEQ ID NO: 9131 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTPESGPG

SEQ ID NO: 9132 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTPETPGS

SEQ ID NO: 9133 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXSGSETGTP

SEQ ID NO: 9134 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTPEGSAP

SEQ ID NO: 9135 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXEPSESATP

SEQ ID NO: 9136 - protein, 8 aa, synthetic construct
PGTGTSAT

SEQ ID NO: 9137 - protein, 7 aa, synthetic construct
PGSGPGT

SEQ ID NO: 9138 - protein, 8 aa, synthetic construct
PGTTPGTT

SEQ ID NO: 9139 - protein, 8 aa, synthetic construct
PGTPPTST

SEQ ID NO: 9140 - protein, 8 aa, synthetic construct
PGTSPSAT

SEQ ID NO: 9141 - protein, 8 aa, synthetic construct
PGTGSAGT

SEQ ID NO: 9142 - protein, 8 aa, synthetic construct
PGTGGAGT

SEQ ID NO: 9143 - protein, 8 aa, synthetic construct
PGTSPGAT

SEQ ID NO: 9144 - protein, 8 aa, synthetic construct
PGTSGSGT

SEQ ID NO: 9145 - protein, 8 aa, synthetic construct
PGTSSAST

SEQ ID NO: 9146 - protein, 8 aa, synthetic construct
PGTGAGTT

SEQ ID NO: 9147 - protein, 8 aa, synthetic construct
PGTGSTST

SEQ ID NO: 9148 - protein, 8 aa, synthetic construct
GSEPATSG

SEQ ID NO: 9149 - protein, 8 aa, synthetic construct
APGTSTEP

SEQ ID NO: 9150 - protein, 8 aa, synthetic construct
PGTAGSGT

SEQ ID NO: 9151 - protein, 8 aa, synthetic construct
PGTSSGGT

SEQ ID NO: 9152 - protein, 8 aa, synthetic construct
PGTAGPAT

SEQ ID NO: 9153 - protein, 8 aa, synthetic construct
PGTPGTGT

SEQ ID NO: 9154 - protein, 8 aa, synthetic construct
PGTGGPTT

SEQ ID NO: 9155 - protein, 8 aa, synthetic construct
PGTGSGST

SEQ ID NO: 9156 - protein, 4 aa, synthetic construct
TGTS

SEQ ID NO: 9157 - protein, 4 aa, synthetic construct
TTPG

SEQ ID NO: 9158 - protein, 4 aa, synthetic construct
TPPT

SEQ ID NO: 9159 - protein, 4 aa, synthetic construct
TSPS

SEQ ID NO: 9160 - protein, 4 aa, synthetic construct
TGSA

SEQ ID NO: 9161 - protein, 4 aa, synthetic construct
TGGA

SEQ ID NO: 9162 - protein, 4 aa, synthetic construct
TSPG

SEQ ID NO: 9163 - protein, 4 aa, synthetic construct
TSGS

SEQ ID NO: 9164 - protein, 4 aa, synthetic construct
TSSA

SEQ ID NO: 9165 - protein, 4 aa, synthetic construct
TGAG

SEQ ID NO: 9166 - protein, 4 aa, synthetic construct
TGST

SEQ ID NO: 9167 - protein, 4 aa, synthetic construct
EPAT

SEQ ID NO: 9168 - protein, 4 aa, synthetic construct
GTST

SEQ ID NO: 9169 - protein, 4 aa, synthetic construct
TAGS

SEQ ID NO: 9170 - protein, 4 aa, synthetic construct
TSSG

SEQ ID NO: 9171 - protein, 4 aa, synthetic construct
TAGP

SEQ ID NO: 9172 - protein, 4 aa, synthetic construct
TPGT

SEQ ID NO: 9173 - protein, 4 aa, synthetic construct
TGGP

SEQ ID NO: 9174 - protein, 4 aa, synthetic construct
TGSG

SEQ ID NO: 9175 - protein, 66 aa, synthetic construct; identical to SEQ ID NO: 9080
  VARIANT 9..58: note = Up to 50 X residues may be deleted
  VARIANT 9..58: note = X can be any amino acid

SEQ ID NO: 9176 - protein, 10 aa, synthetic construct
ASSATPESGP

SEQ ID NO: 9177 - protein, 7 aa, synthetic construct
ATPESGP

SEQ ID NO: 9178 - protein, 11 aa, synthetic construct
GPGGQHHHHHH

SEQ ID NO: 9179 - protein, 126 aa, synthetic construct
EVQLVESGGGLVQPGGSLRLSCAASGRTFGIYVMGWVRQAPGKEREFVSAISWSGSNRLVSDSVKGRFTISRDNSKNTLYLQMNSLRAEDTAVYYCAASNRLYGRTWYDFNESDYWGQGTQVTVSS

SEQ ID NO: 9180 - protein, 126 aa, synthetic construct
EVQLVESGGGLVQPGGSLRLSCAASGRTFGIYVMGWVRQAPGKEREFVSAISWSGSNRLVSDSVKGRFTISRDNAKNSLYLQMNSLRAEDTAVYYCAASNRLYGRTWYDFNESDYWGQGTQVTVSS

SEQ ID NO: 9181 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9182 - protein, 126 aa, synthetic construct
EVQLVESGGGVVQPGRSLRLSCAASGRTFGIYVMGWVRQAPGKEREFVAAISWSGSNRLVSDSVKGRFTISRDNSKNTLYLQMNSLRAEDTAVYFCAASNRLYGRTWYDFNESDYWGQGTLVTVSS

SEQ ID NO: 9183 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEGTAVYFCAASNRLYGRTWYDFNESDYWGQGTMVTVSS

SEQ ID NO: 9184 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYFCAASNRLYGRTWYDFNESDYWGQGTTVTVSS

SEQ ID NO: 9185 - protein, 126 aa, synthetic construct
EVQLVESGGGLVQPGGSLRLSCAVSGRTFGIYVMGWVRQAPGKEREFVSAISWSGSNRLVSDSVKGRFTISRDNSKNTLYLQMNSLRAEDTASYFCAASNRLYGRTWYDFNESDYWGQGTLVTVSS

SEQ ID NO: 9186 - protein, 126 aa, synthetic construct
EVQLVESGGGVVQPGRSLRISCAASGRTFGIYVMAWFRQAPGKEREFVAVISWSGSNKLVTDSVKGRFTISRDNSKNTVYLQMNSLRPEDTANYFCAASNRLYGRTWYDFNESDYWGQGTLVTVSS

SEQ ID NO: 9187 - protein, 126 aa, synthetic construct
QVQLVESGGGVVQPGRSLRLSCAASGRTFGIYVMAWVRQAPGKEREFVAAISWSGSNRLVSDSVKGRFTISRDNSKNTLYLQMNSLRPEDTAVYFCAASNRLYGRTWYDFNESDYWGQGTLVTVSS

SEQ ID NO: 9188 - protein, 126 aa, synthetic construct
QVQLVESGGGVVQAGGSLSLSCVASGRTFGIYVMAWFRQAPGKEREFLTVISWSGSNKLVTDSVKGRFTISRDNSKNTLYLQMNSLRAEDTGLYFCAASNRLYGRTWYDFNESDYWGQGTLLTVSS

SEQ ID NO: 9189 - protein, 126 aa, synthetic construct
EVKLVESGGGLVQPGRSLRLSCVASGRTFGIYVMGWVRQVPGKSRQFVSAISWSGSNRLVSDSVKGRFTISRDNAKNSLFLQMNSLRPEDTALYFCAASNRLYGRTWYDFNESDYWGQGTQVTVSS

SEQ ID NO: 9190 - protein, 126 aa, synthetic construct
EVQLLESGGGLVQPGGSLRLSCAASGRTFGIYVMGWVRQAPGKEREFVSAISWSGSNRLVSDSVKGRFTISRDNSKNTLYLQMNSLRAEDTAIYFCAASNRLYGRTWYDFNESDYWGQGTLVTVSS

SEQ ID NO: 9191 - protein, 126 aa, synthetic construct
EVQLVESGGGVVQPGRSLRLSCAASGRTFGIYVMGWVRQAPGKEREFVAAISWSGSNRLVSDSVKGRFTISRDNSKNTLYLQMNSLRAEDTAVYFCAASNRLYGRTWYDFNESDYWGQGTTVTVSS

SEQ ID NO: 9192 - protein, 126 aa, synthetic construct
EVQLVESGGGSVQPGGSLRLSCAASGRTFGIYVMAWFRQAPGKEREFVAVISWSGSNRLVTDSVKGRFTISRENSKNTLYLQMNSLRAEDTANYFCAASNRLYGRTWYDFNESDYWGQGTQVTVSS

SEQ ID NO: 9193 - protein, 126 aa, synthetic construct
EVQLVESGGGLVQPGGSLRLSCAASGRTFGIYVMGWFRQAPGKEREFVSVISWSGSNRLVSDSVKGRFTISRENAKNSLYLQMNSLRAEDTANYFCAASNRLYGRTWYDFNESDYWGQGTQVTVSS

SEQ ID NO: 9194 - protein, 126 aa, synthetic construct
EVQLVESGGGLVQPGGSLRLSCAASGRTFGIYVMAWFRQAPGKEREFVSAISWSGSNRLVSDSVKGRFTISRDNSKNTLYLQMNSLRAEDTAVYFCAASNRLYGRTWYDFNESDYWGQGTQVTVSS

SEQ ID NO: 9195 - protein, 126 aa, synthetic construct
EVQLVESGGGLVQPGGSLRLSCAVSGRTFGIYVMGWVRQAPGKEREFVSAITWSGTNRLVSDSVKGRFTISRDNSKNTLYLQMNSLRAEDTASYFCAASNRLYGRTWYDFNESDYWGQGTLVTVSS

SEQ ID NO: 9196 - protein, 126 aa, synthetic construct
EVQLVESGGGLVQPGGSLRLSCAVSGRTFGIYVLGWFRQAPGKEREFVSAISWSGSNRLVSDSVKGRFTISRDNSKNTLYLQMNSLRAEDTASYFCAGSNRLYGRTWYDFNESDYWGQGTQVTVSS

SEQ ID NO: 9197 - protein, 126 aa, synthetic construct
EVQLVESGGGLVQPGGSLRLSCAVSGRTFGIYVLGWFRQAPGKEREFVSAITWSGTNRLVSDSVKGRFTISRDNSKNTLYLQMNSLRAEDTASYFCAGSNRLYGRTWYDFNESDYWGQGTQVTVSS

SEQ ID NO: 9198 - protein, 126 aa, synthetic construct
EVQLVESGGGLVQPGGSLRLSCAVSGRTFGIYVLGWFRQAPGKEREFVSAITWSGTNRLVSDSVKGRFTISRDNSKNTLYLQMNSLRAEDTASYFCGASNRLYGRTWYDFNESDYWGQGTQVTVSS

SEQ ID NO: 9199 - protein, 126 aa, synthetic construct
EVQLLESGGGLVQPGGSLRLSCAASGRTFGIYVLGWFRQAPGKEREFVSAISYSGSNRLVSDSVKGRFTISRDNSKNTLYLQMNSLRAEDTAIYFCGASNRLYGRTWYDFNESDYWGQGTQVTVSS

SEQ ID NO: 9200 - protein, 126 aa, synthetic construct
EVQLLESGGGLVQPGGSLRLSCAASGRTFGIYVMGWFRQAPGKEREFVSAISWSGSDRLVSDSVKGRFTISRDNSKNTLYLQMNSLRAEDTAIYFCAASNRLYGRTWYDFNESDYWGQGTLVTVSS

SEQ ID NO: 9201 - protein, 126 aa, synthetic construct
EVQLLESGGGLVQPGGSLRLSCAASGRTFGIYVMGWVRQAPGKEREFVSAITWSGTNRLVSDSVKGRFTISRDNSKNTLYLQMNSLRAEDTAIYFCGASNRLYGRTWYDFNESDYWGQGTLVTVSS

SEQ ID NO: 9202 - protein, 126 aa, synthetic construct
EVQLVESGGGSVQPGGSLRLSCAASGRTFGIYVMAWFRQAPGKEREFVAVISWSGTNRLVTDSVKGRFTISRENSKNTLYLQMNSLRAEDTANYFCAGSNRLYGRTWYDFNESDYWGQGTQVTVSS

SEQ ID NO: 9203 - protein, 126 aa, synthetic construct
EVQLVESGGGSVQPGGSLRLSCAASGRTFGIYVMAWFRQAPGKEREFVAVISWSGTNRLVTDSVKGRFTISRENSKNTLYLQMNSLRAEDTANYFCGASNRLYGRTWYDFNESDYWGQGTQVTVSS

SEQ ID NO: 9204 - protein, 126 aa, synthetic construct
EVQLVESGGGSVQPGGSLRLSCAASGRTFGIYVMAWFRQAPGKEREFVAVITWSGTNRLVTDSVKGRFTISRENSKNTLYLQMNSLRAEDTANYFCGASNRLYGRTWYDFNESDYWGQGTQVTVSS

SEQ ID NO: 9205 - protein, 126 aa, synthetic construct
QVQLVESGGGVVQPGRSLRLSCAASGRTFDVYAMGWFRQAPGKERELVAAINWSGSNKFHADSVKGRFTISRDNSKNTLYLQMNSLRAEDTAVYFCAASTRLYGTTWYEFNDSDYWGQGTQVTVSS

SEQ ID NO: 9206 - protein, 126 aa, synthetic construct
EVQLLESGGGLVQPGGSLRLSCAASGRTFDVYAMGWFRQAPGKERELVSAINWSGSNKFHADSVKGRFTISRDNSKNTLYLQMNSLRAEDTAVYFCAASTRLYGTTWYEFNDSDYWGQGTQVTVSS

SEQ ID NO: 9207 - protein, 126 aa, synthetic construct
EVQLVESGGGLVQPGGSLRLSCAASGRTFDVYAMSWVRQAPGKERELVAAINWSGSNKFHADSVKGRFTISRDNAKNSLYLQMNSLRAEDTAVYFCAASTRLYGTTWYEFNDSDYWGQGTQVTVSS

SEQ ID NO: 9208 - protein, 126 aa, synthetic construct
QVQLVESGGGLVQPGGSLRLSCSASGRTFDVYAMGWVRQAPGKERELVSAINWSGSNKFHADSVKGRFTISRDNSKNTLYLQMNSLRAEDTAVYFCAASTRLYGTTWYEFNDSDYWGQGTQVTVSS

SEQ ID NO: 9209 - protein, 126 aa, synthetic construct
QVQLEESGGGVVQPGRSLRLSCVVSGRTFDVYAMGWVRQAPGKERELVAAINWSGSNKFHADSVKGRFTISRDNSKNTLNLQMNSLRPEDTAVYFCAASTRLYGTTWYEFNDSDYWGQGTQVTVSS

SEQ ID NO: 9210 - protein, 126 aa, synthetic construct
QVQLVESGGGVVQPGRSLRLSCAASGRTFDVYAMAWFRQAPGKERELVAAINWSGSNKFHADSVKGRFTISRDNSKNTLFLQMNSLRPEDTAVYFCAASTRLYGTTWYEFNDSDYWGQGTQVTVSS

SEQ ID NO: 9211 - protein, 126 aa, synthetic construct
QVQLVQSGGGVVQPGRSLRLSCAASGRTFDVYAMGWFRQAPGKERELVAAINWSGSNKFHADSVKGRFTISRDNSKNTLSLQMNSLRAEDTAVYFCAASTRLYGTTWYEFNDSDYWGQGTQVTVSS

SEQ ID NO: 9212 - protein, 126 aa, synthetic construct
QVQLVESGGGVVQPGRSLRLSCAASGRTFDVYAMGWFRQAPGKERELVAAINWSGSNKFHADSVKGRFTISRDNSRNTLYLQMNSLRAEDTAVYFCAASTRLYGTTWYEFNDSDYWGQGTQVTVSS

SEQ ID NO: 9213 - protein, 126 aa, synthetic construct
QVQLVESGGGVVQPGRSLRLSCAASGRTFDVYAMGWFRQAPGKGRELVAAINWSGSNKFHADSVKGRFTISRDNSKNTLYLQMNSLRPEDTAVYFCAASTRLYGTTWYEFNDSDYWGQGTQVTVSS

SEQ ID NO: 9214 - protein, 126 aa, synthetic construct
QVQLVESGGGVVQPGRSLRLSCAASGRTFDVYAMGWFRQAPGKERELVAAINWSGSNKFHADSVKGRFTISRDNSKKTLYLQMNSLRAEDTAVYFCAASTRLYGTTWYEFNDSDYWGQGTQVTVSS

SEQ ID NO: 9215 - protein, 126 aa, synthetic construct
EVQLVESGGGLVQPGGSLRLSCAASGRTFDVYAMGWFRQAPGKGRELVSAINWSGSNKFHADSVKGRFTISRDNSKNTLYLQMNSLRAEDTAVYFCAASTRLYGTTWYEFNDSDYWGQGTQVTVSS

SEQ ID NO: 9216 - protein, 126 aa, synthetic construct
QVQLVESGGGVVQPGRSLRLSCAASGRTFDVYAMGWFRQAPGKERELVAAINWSGSNKFHADSVKGRFTISRDNSKNTLFLQMNSLRADDTAVYFCAASTRLYGTTWYEFNDSDYWGQGTQVTVSS

SEQ ID NO: 9217 - protein, 126 aa, synthetic construct
QVQVIESGGGVVQSGKSLRLACTTSGRTFDVYAMGWFRQAPGKGRELVAAINWSGSNKFHADSVKGRFTISRDNSKNTLYLQMNSLRAEDTAVYFCAASTRLYGTTWYEFNDSDYWGQGTQVTVSS

SEQ ID NO: 9218 - protein, 126 aa, synthetic construct
QVQLVESGGGVVQPGRSLRLSCAASGRTFDVYAMGWVRQAPGKERELVAAINWSGSNKFHADSVKGRFTISRDNSKNTLYLQMNSLKTEDTAMYFCAASTRLYGTTWYEFNDSDYWGQGTQVTVSS

SEQ ID NO: 9219 - protein, 126 aa, synthetic construct
EVQLLESGGGLVQSGDSLRLSCATSGRTFDVYAMSWFRQAPGKERELVSAIDWSGSNKFHADSVKGRFTISRDNSWKTLYLQMNSLRPEDTAVYFCAASTRLYGTTWYEFNDSDYWGQGTQVTVSS

SEQ ID NO: 9220 - protein, 126 aa, synthetic construct
QVQLVESGGGLVQPGRSLRLSCATSGFTFDVYAMGWFRQAPGKERELVSAINWGGSNKFHADSVKGRFTISRDNAWKTLYLQMNSLRAEDTAVYFCAASTRLYGTTWYEFNDSDYWGQGTQVTVSS

SEQ ID NO: 9221 - protein, 126 aa, synthetic construct
QVQLVESGGGVVQPGDSLRLSCATSGRTFDVYAMGWFRQAPGKERELVAAINWAGSNKFHADSVKGRFTISRDNSKNTLSLQMNSLRAEDTAVYFCAASTRLYGTTWYEFNDSDYWGQGTQVTVSS

SEQ ID NO: 9222 - protein, 126 aa, synthetic construct
QVQLVESGGGVVQPGDSLRLSCATSGRTFDVYAMSWFRQAPGKERELVAAINWAGSNKFHADSVKGRFTISRDNSKNTLSLQMNSLRPEDTAVYFCAASTRLYGTTWYEFNDSDYWGQGTQVTVSS

SEQ ID NO: 9223 - protein, 126 aa, synthetic construct
QVQLVESGGGVVQPGDSLRLSCATSGRTFDVYAMAWFRQAPGKERELVAAINWAGSNKFHADSVKGRFTISRDNSKNTLSLQMNSLRPEDTAVYFCAASTRLYGTTWYEFNDSDYWGQGTQVTVSS

SEQ ID NO: 9224 - protein, 126 aa, synthetic construct
QVQLVESGGGVVQPGDSLRLSCATSGRTFDVYAMAWFRQAPGKERELVAAINWGGSNKFHADSVKGRFTISRDNSKNTLSLQMNSLRPEDTAVYFCAASTRLYGTTWYEFNDSDYWGQGTQVTVSS

SEQ ID NO: 9225 - protein, 126 aa, synthetic construct
EVQLLESGGGLVQSGDSLRLSCATSGRTFDVYAMSWFRQAPGKERELVSAINWSGSNKFHADSVKGRFTISRDNSWKTLYLQMNSLRPEDTAVYFCGATSRLYGTTWYEFNDSDYWGQGTQVTVSS

SEQ ID NO: 9226 - protein, 126 aa, synthetic construct
QVQLVESGGGLVQPGRSLRLSCATSGFTFDVYAMGWFRQAPGKERELVSAINWSGSNKFHADSVKGRFTISRDNAWKTLYLQMNSLRAEDTAVYFCAGSTRLYGTTWYEFNDSDYWGQGTQVTVSS

SEQ ID NO: 9227 - protein, 126 aa, synthetic construct
QVQLVESGGGVVQPGDSLRLSCATSGRTFDVYAMGWFRQAPGKERELVAAINWSGSNKFHADSVKGRFTISRDNSKNTLSLQMNSLRAEDTAVYFCGASTRLYGTTWYEFNDSDYWGQGTQVTVSS

SEQ ID NO: 9228 - protein, 126 aa, synthetic construct
QVQLVESGGGVVQPGDSLRLSCATSGRTFDVYAMSWFRQAPGKERELVAAINWSGSNKFHADSVKGRFTISRDNSKNTLSLQMNSLRPEDTAVYFCAGTSRLYGTTWYEFNDSDYWGQGTQVTVSS

SEQ ID NO: 9229 - protein, 126 aa, synthetic construct
QVQLVESGGGVVQPGDSLRLSCATSGRTFDVYAMAWFRQAPGKERELVAAINWSGSNKFHADSVKGRFTISRDNSKNTLSLQMNSLRPEDTAVYFCAGTTRLYGTTWYEFNDSDYWGQGTQVTVSS

SEQ ID NO: 9230 - protein, 126 aa, synthetic construct
EVQLLESGGGLVQSGDSLRLSCATSGRTFDVYAMSWFRQAPGKERELVSAIDWSGSNKFHADSVKGRFTISRDNSWKTLYLQMNSLRPEDTAVYFCGATSRLYGTTWYEFNDSDYWGQGTQVTVSS

SEQ ID NO: 9231 - protein, 126 aa, synthetic construct
QVQLVESGGGLVQPGRSLRLSCATSGFTFDVYAMGWFRQAPGKERELVSAINWGGSNKFHADSVKGRFTISRDNAWKTLYLQMNSLRAEDTAVYFCAGSTRLYGTTWYEFNDSDYWGQGTQVTVSS

SEQ ID NO: 9232 - protein, 126 aa, synthetic construct
QVQLVESGGGVVQPGDSLRLSCATSGRTFDVYAMGWFRQAPGKERELVAAINWAGSNKFHADSVKGRFTISRDNSKNTLSLQMNSLRAEDTAVYFCGASTRLYGTTWYEFNDSDYWGQGTQVTVSS

SEQ ID NO: 9233 - protein, 126 aa, synthetic construct
QVQLVESGGGVVQPGDSLRLSCATSGRTFDVYAMSWFRQAPGKERELVAAINWAGSNKFHADSVKGRFTISRDNSKNTLSLQMNSLRPEDTAVYFCAGTSRLYGTTWYEFNDSDYWGQGTQVTVSS

SEQ ID NO: 9234 - protein, 126 aa, synthetic construct
QVQLVESGGGVVQPGDSLRLSCATSGRTFDVYAMAWFRQAPGKERELVAAINWAGSNKFHADSVKGRFTISRDNSKNTLSLQMNSLRPEDTAVYFCAGTTRLYGTTWYEFNDSDYWGQGTQVTVSS

SEQ ID NO: 9235 - protein, 126 aa, synthetic construct
QVQLVESGGGVVQPGDSLRLSCATSGRTFDVYALAWFRQAPGKERELVAAINWGGSNKFHADSVKGRFTISRDNSKNTLSLQMNSLRPEDTAVYFCAGTSRLYGTTWYEFNDSDYWGQGTQVTVSS

SEQ ID NO: 9236 - protein, 126 aa, synthetic construct
QVQLVESGGGVVQPGRSLRLSCAASGRTFGIYVFGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9237 - protein, 126 aa, synthetic construct
QVQLVESGGGVVQPGRSLRLSCAASGRTFGIYVMGWARQAPGKEREFVAAISWTGSNRYVSDSVKGRFTISRDNSKNTLYLQMNSLRAEDTAVYYCAASNRTYGRTWYDFNESDYWGQGTQVTVSS

SEQ ID NO: 9238 - protein, 126 aa, synthetic construct
QVQLVESGGGVVQPGRSLRLSCAASGRTFGIKVMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9239 - protein, 126 aa, synthetic construct
QVQLVESGGGVVQPGRSLRLSCAASGRTFGIYAMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9240 - protein, 126 aa, synthetic construct
QVQLVESGGGVVQPGRSLRLSCAASGRTFGIYHMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9241 - protein, 126 aa, synthetic construct
QVQLVESGGGVVQPGRSLRLSCAASGRTFGIYPMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9242 - protein, 126 aa, synthetic construct
QVQLVESGGGVVQPGRSLRLSCAASGRTFGIYWMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9243 - protein, 126 aa, synthetic construct
QVQLVESGGGVVQPGRSLRLSCAASGRTFGIYYMGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9244 - protein, 126 aa, synthetic construct
QVQLVESGGGVVQPGRSLRLSCAASGRTFGIYVWGWVRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9245 - protein, 126 aa, synthetic construct
QVQLVESGGGVVQPGRSLRLSCAASGRTFGIYVMGWARQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9246 - protein, 126 aa, synthetic construct
QVQLVESGGGVVQPGRSLRLSCAASGRTFGIYVMGWIRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9247 - protein, 126 aa, synthetic construct
QVQLVESGGGVVQPGRSLRLSCAASGRTFGIYVMGWFRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9248 - protein, 126 aa, synthetic construct
QVQLVESGGGVVQPGRSLRLSCAASGRTFGIYVMGWPRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9249 - protein, 126 aa, synthetic construct
QVQLVESGGGVVQPGRSLRLSCAASGRTFGIYVMGWYRQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9250 - protein, 126 aa, synthetic construct
QVQLVESGGGVVQPGRSLRLSCAASGRTFGIYVMGWVQQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9251 - protein, 126 aa, synthetic construct
QVQLVESGGGVVQPGRSLRLSCAASGRTFGIYVMGWVKQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9252 - protein, 126 aa, synthetic construct
QVQLVESGGGVVQPGRSLRLSCAASGRTFGIYVMGWVSQAPGKEREFVAAISWSGSNRLVSDSVKGRFTISRDNSKNTLYLQMNSLRAEDTAVYYCAASNRLYGRTWYDFNESDYWGQGTQVTVSS

SEQ ID NO: 9253 - protein, 126 aa, synthetic construct
QVQLVESGGGVVQPGRSLRLSCAASGRTFGIYVMGWVRQAPGKERELVAAISWSGSNRLVSDSVKGRFTISRDNSKNTLYLQMNSLRAEDTAVYYCAASNRLYGRTWYDFNESDYWGQGTQVTVSS

SEQ ID NO: 9254 - protein, 126 aa, synthetic construct
QVQLVESGGGVVQPGRSLRLSCAASGRTFGIYVMGWVRQAPGKEREWVAAISWSGSNRLVSDSVKGRFTISRDNSKNTLYLQMNSLRAEDTAVYYCAASNRLYGRTWYDFNESDYWGQGTQVTVSS

SEQ ID NO: 9255 - protein, 126 aa, synthetic construct
QVQLVESGGGVVQPGRSLRLSCAASGRTFGIYVMGWVRQAPGKEREYVAAISWSGSNRLVSDSVKGRFTISRDNSKNTLYLQMNSLRAEDTAVYYCAASNRLYGRTWYDFNESDYWGQGTQVTVSS

SEQ ID NO: 9256 - protein, 126 aa, synthetic construct
QVQLVESGGGVVQPGRSLRLSCAASGRTFGIYVMGWVRQAPGKEREFWAAISWSGSNRLVSDSVKGRFTISRDNSKNTLYLQMNSLRAEDTAVYYCAASNRLYGRTWYDFNESDYWGQGTQVTVSS

SEQ ID NO: 9257 - protein, 126 aa, synthetic construct
QVQLVESGGGVVQPGRSLRLSCAASGRTFGIYVMGWVRQAPGKEREFVGAISWSGSNRLVSDSVKGRFTISRDNSKNTLYLQMNSLRAEDTAVYYCAASNRLYGRTWYDFNESDYWGQGTQVTVSS

SEQ ID NO: 9258 - protein, 126 aa, synthetic construct
QVQLVESGGGVVQPGRSLRLSCAASGRTFGIYVMGWVRQAPGKEREFVAAASWSGSNRLVSDSVKGRFTISRDNSKNTLYLQMNSLRAEDTAVYYCAASNRLYGRTWYDFNESDYWGQGTQVTVSS

SEQ ID NO: 9259 - protein, 126 aa, synthetic construct
QVQLVESGGGVVQPGRSLRLSCAASGRTFGIYVMGWVRQAPGKEREFVAARSWSGSNRLVSDSVKGRFTISRDNSKNTLYLQMNSLRAEDTAVYYCAASNRLYGRTWYDFNESDYWGQGTQVTVSS

SEQ ID NO: 9260 - protein, 126 aa, synthetic construct
QVQLVESGGGVVQPGRSLRLSCAASGRTFGIYVMGWVRQAPGKEREFVAAESWSGSNRLVSDSVKGRFTISRDNSKNTLYLQMNSLRAEDTAVYYCAASNRLYGRTWYDFNESDYWGQGTQVTVSS

SEQ ID NO: 9261 - protein, 126 aa, synthetic construct
QVQLVESGGGVVQPGRSLRLSCAASGRTFGIYVMGWVRQAPGKEREFVAAQSWSGSNRLVSDSVKGRFTISRDNSKNTLYLQMNSLRAEDTAVYYCAASNRLYGRTWYDFNESDYWGQGTQVTVSS

SEQ ID NO: 9262 - protein, 126 aa, synthetic construct
QVQLVESGGGVVQPGRSLRLSCAASGRTFGIYVMGWVRQAPGKEREFVAAGSWSGSNRLVSDSVKGRFTISRDNSKNTLYLQMNSLRAEDTAVYYCAASNRLYGRTWYDFNESDYWGQGTQVTVSS

SEQ ID NO: 9263 - protein, 126 aa, synthetic construct
QVQLVESGGGVVQPGRSLRLSCAASGRTFGIYVMGWVRQAPGKEREFVAAHSWSGSNRLVSDSVKGRFTISRDNSKNTLYLQMNSLRAEDTAVYYCAASNRLYGRTWYDFNESDYWGQGTQVTVSS

SEQ ID NO: 9264 - protein, 126 aa, synthetic construct
QVQLVESGGGVVQPGRSLRLSCAASGRTFGIYVMGWVRQAPGKEREFVAAMSWSGSNRLVSDSVKGRFTISRDNSKNTLYLQMNSLRAEDTAVYYCAASNRLYGRTWYDFNESDYWGQGTQVTVSS

SEQ ID NO: 9265 - protein, 126 aa, synthetic construct
QVQLVESGGGVVQPGRSLRLSCAASGRTFGIYVMGWVRQAPGKEREFVAAPSWSGSNRLVSDSVKGRFTISRDNSKNTLYLQMNSLRAEDTAVYYCAASNRLYGRTWYDFNESDYWGQGTQVTVSS

SEQ ID NO: 9266 - protein, 126 aa, synthetic construct
QVQLVESGGGVVQPGRSLRLSCAASGRTFGIYVMGWVRQAPGKEREFVAASSWSGSNRLVSDSVKGRFTISRDNSKNTLYLQMNSLRAEDTAVYYCAASNRLYGRTWYDFNESDYWGQGTQVTVSS

SEQ ID NO: 9267 - protein, 126 aa, synthetic construct
QVQLVESGGGVVQPGRSLRLSCAASGRTFGIYVMGWVRQAPGKEREFVAAWSWSGSNRLVSDSVKGRFTISRDNSKNTLYLQMNSLRAEDTAVYYCAASNRLYGRTWYDFNESDYWGQGTQVTVSS

SEQ ID NO: 9268 - protein, 126 aa, synthetic construct
QVQLVESGGGVVQPGRSLRLSCAASGRTFGIYVMGWVRQAPGKEREFVAAVSWSGSNRLVSDSVKGRFTISRDNSKNTLYLQMNSLRAEDTAVYYCAASNRLYGRTWYDFNESDYWGQGTQVTVSS

SEQ ID NO: 9269 - protein, 126 aa, synthetic construct
QVQLVESGGGVVQPGRSLRLSCAASGRTFGIYVMGWVRQAPGKEREFVAAIAWSGSNRLVSDSVKGRFTISRDNSKNTLYLQMNSLRAEDTAVYYCAASNRLYGRTWYDFNESDYWGQGTQVTVSS

SEQ ID NO: 9270 - protein, 126 aa, synthetic construct
QVQLVESGGGVVQPGRSLRLSCAASGRTFGIYVMGWVRQAPGKEREFVAAIDWSGSNRLVSDSVKGRFTISRDNSKNTLYLQMNSLRAEDTAVYYCAASNRLYGRTWYDFNESDYWGQGTQVTVSS

SEQ ID NO: 9271 - protein, 126 aa, synthetic construct
QVQLVESGGGVVQPGRSLRLSCAASGRTFGIYVMGWVRQAPGKEREFVAAIEWSGSNRLVSDSVKGRFTISRDNSKNTLYLQMNSLRAEDTAVYYCAASNRLYGRTWYDFNESDYWGQGTQVTVSS

SEQ ID NO: 9272 - protein, 126 aa, synthetic construct
QVQLVESGGGVVQPGRSLRLSCAASGRTFGIYVMGWVRQAPGKEREFVAAIHWSGSNRLVSDSVKGRFTISRDNSKNTLYLQMNSLRAEDTAVYYCAASNRLYGRTWYDFNESDYWGQGTQVTVSS

SEQ ID NO: 9273 - protein, 126 aa, synthetic construct
QVQLVESGGGVVQPGRSLRLSCAASGRTFGIYVMGWVRQAPGKEREFVAAIPWSGSNRLVSDSVKGRFTISRDNSKNTLYLQMNSLRAEDTAVYYCAASNRLYGRTWYDFNESDYWGQGTQVTVSS

SEQ ID NO: 9274 - protein, 126 aa, synthetic construct
QVQLVESGGGVVQPGRSLRLSCAASGRTFGIYVMGWVRQAPGKEREFVAAITWSGSNRLVSDSVKGRFTISRDNSKNTLYLQMNSLRAEDTAVYYCAASNRLYGRTWYDFNESDYWGQGTQVTVSS

SEQ ID NO: 9275 - protein, 126 aa, synthetic construct
QVQLVESGGGVVQPGRSLRLSCAASGRTFGIYVMGWVRQAPGKEREFVAAIWWSGSNRLVSDSVKGRFTISRDNSKNTLYLQMNSLRAEDTAVYYCAASNRLYGRTWYDFNESDYWGQGTQVTVSS

SEQ ID NO: 9276 - protein, 126 aa, synthetic construct
QVQLVESGGGVVQPGRSLRLSCAASGRTFGIYVMGWVRQAPGKEREFVAAIYWSGSNRLVSDSVKGRFTISRDNSKNTLYLQMNSLRAEDTAVYYCAASNRLYGRTWYDFNESDYWGQGTQVTVSS

SEQ ID NO: 9277 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRYYGRTWYDFNESDYWGQGTQVTVSS

SEQ ID NO: 9278 - protein, 126 aa, synthetic construct
QVQLVESGGGVVQPGRSLRLSCAASGRTFGIYVMGWVRQAPGKEREFVAAISWWGSNRLVSDSVKGRFTISRDNSKNTLYLQMNSLRAEDTAVYYCAASNRLYGRTWYDFNESDYWGQGTQVTVSS

SEQ ID NO: 9279 - protein, 126 aa, synthetic construct
QVQLVESGGGVVQPGRSLRLSCAASGRTFGIYVMGWVRQAPGKEREFVAAISWSGLNRLVSDSVKGRFTISRDNSKNTLYLQMNSLRAEDTAVYYCAASNRLYGRTWYDFNESDYWGQGTQVTVSS

SEQ ID NO: 9280 - protein, 126 aa, synthetic construct
QVQLVESGGGVVQPGRSLRLSCAASGRTFGIYVMGWVRQAPGKEREFVAAISWSGPNRLVSDSVKGRFTISRDNSKNTLYLQMNSLRAEDTAVYYCAASNRLYGRTWYDFNESDYWGQGTQVTVSS

SEQ ID NO: 9281 - protein, 126 aa, synthetic construct
QVQLVESGGGVVQPGRSLRLSCAASGRTFGIYVMGWVRQAPGKEREFVAAISWSGTNRLVSDSVKGRFTISRDNSKNTLYLQMNSLRAEDTAVYYCAASNRLYGRTWYDFNESDYWGQGTQVTVSS

SEQ ID NO: 9282 - protein, 126 aa, synthetic construct
QVQLVESGGGVVQPGRSLRLSCAASGRTFGIYVMGWVRQAPGKEREFVAAISWSGSDRLVSDSVKGRFTISRDNSKNTLYLQMNSLRAEDTAVYYCAASNRLYGRTWYDFNESDYWGQGTQVTVSS

SEQ ID NO: 9283 - protein, 126 aa, synthetic construct
QVQLVESGGGVVQPGRSLRLSCAASGRTFGIYVMGWVRQAPGKEREFVAAISWSGSQRLVSDSVKGRFTISRDNSKNTLYLQMNSLRAEDTAVYYCAASNRLYGRTWYDFNESDYWGQGTQVTVSS

SEQ ID NO: 9284 - protein, 126 aa, synthetic construct
QVQLVESGGGVVQPGRSLRLSCAASGRTFGIYVMGWVRQAPGKEREFVAAISWSGSGRLVSDSVKGRFTISRDNSKNTLYLQMNSLRAEDTAVYYCAASNRLYGRTWYDFNESDYWGQGTQVTVSS

SEQ ID NO: 9285 - protein, 126 aa, synthetic construct
QVQLVESGGGVVQPGRSLRLSCAASGRTFGIYVMGWVRQAPGKEREFVAAISWSGSHRLVSDSVKGRFTISRDNSKNTLYLQMNSLRAEDTAVYYCAASNRLYGRTWYDFNESDYWGQGTQVTVSS

SEQ ID NO: 9286 - protein, 126 aa, synthetic construct
QVQLVESGGGVVQPGRSLRLSCAASGRTFGIYVMGWVRQAPGKEREFVAAISWSGSFRLVSDSVKGRFTISRDNSKNTLYLQMNSLRAEDTAVYYCAASNRLYGRTWYDFNESDYWGQGTQVTVSS

SEQ ID NO: 9287 - protein, 126 aa, synthetic construct
QVQLVESGGGVVQPGRSLRLSCAASGRTFGIYVMGWVRQAPGKEREFVAAISWSGSPRLVSDSVKGRFTISRDNSKNTLYLQMNSLRAEDTAVYYCAASNRLYGRTWYDFNESDYWGQGTQVTVSS

SEQ ID NO: 9288 - protein, 126 aa, synthetic construct
QVQLVESGGGVVQPGRSLRLSCAASGRTFGIYVMGWVRQAPGKEREFVAAISWSGSNALVSDSVKGRFTISRDNSKNTLYLQMNSLRAEDTAVYYCAASNRLYGRTWYDFNESDYWGQGTQVTVSS

SEQ ID NO: 9289 - protein, 126 aa, synthetic construct
QVQLVESGGGVVQPGRSLRLSCAASGRTFGIYVMGWVRQAPGKEREFVAAISWSGSNQLVSDSVKGRFTISRDNSKNTLYLQMNSLRAEDTAVYYCAASNRLYGRTWYDFNESDYWGQGTQVTVSS

SEQ ID NO: 9290 - protein, 126 aa, synthetic construct
QVQLVESGGGVVQPGRSLRLSCAASGRTFGIYVMGWVRQAPGKEREFVAAISWSGSNILVSDSVKGRFTISRDNSKNTLYLQMNSLRAEDTAVYYCAASNRLYGRTWYDFNESDYWGQGTQVTVSS

SEQ ID NO: 9291 - protein, 126 aa, synthetic construct
QVQLVESGGGVVQPGRSLRLSCAASGRTFGIYVMGWVRQAPGKEREFVAAISWSGSNTLVSDSVKGRFTISRDNSKNTLYLQMNSLRAEDTAVYYCAASNRLYGRTWYDFNESDYWGQGTQVTVSS

SEQ ID NO: 9292 - protein, 126 aa, synthetic construct
QVQLVESGGGVVQPGRSLRLSCAASGRTFGIYVMGWVRQAPGKEREFVAAISWSGSNRAVSDSVKGRFTISRDNSKNTLYLQMNSLRAEDTAVYYCAASNRLYGRTWYDFNESDYWGQGTQVTVSS

SEQ ID NO: 9293 - protein, 126 aa, synthetic construct
QVQLVESGGGVVQPGRSLRLSCAASGRTFGIYVMGWVRQAPGKEREFVAAISWSGSNRNVSDSVKGRFTISRDNSKNTLYLQMNSLRAEDTAVYYCAASNRLYGRTWYDFNESDYWGQGTQVTVSS

SEQ ID NO: 9294 - protein, 126 aa, synthetic construct
QVQLVESGGGVVQPGRSLRLSCAASGRTFGIYVMGWVRQAPGKEREFVAAISWSGSNREVSDSVKGRFTISRDNSKNTLYLQMNSLRAEDTAVYYCAASNRLYGRTWYDFNESDYWGQGTQVTVSS

SEQ ID NO: 9295 - protein, 126 aa, synthetic construct
QVQLVESGGGVVQPGRSLRLSCAASGRTFGIYVMGWVRQAPGKEREFVAAISWSGSNRQVSDSVKGRFTISRDNSKNTLYLQMNSLRAEDTAVYYCAASNRLYGRTWYDFNESDYWGQGTQVTVSS

SEQ ID NO: 9296 - protein, 126 aa, synthetic construct
QVQLVESGGGVVQPGRSLRLSCAASGRTFGIYVMGWVRQAPGKEREFVAAISWSGSNRGVSDSVKGRFTISRDNSKNTLYLQMNSLRAEDTAVYYCAASNRLYGRTWYDFNESDYWGQGTQVTVSS

SEQ ID NO: 9297 - protein, 126 aa, synthetic construct
QVQLVESGGGVVQPGRSLRLSCAASGRTFGIYVMGWVRQAPGKEREFVAAISWSGSNRHVSDSVKGRFTISRDNSKNTLYLQMNSLRAEDTAVYYCAASNRLYGRTWYDFNESDYWGQGTQVTVSS

SEQ ID NO: 9298 - protein, 126 aa, synthetic construct
QVQLVESGGGVVQPGRSLRLSCAASGRTFGIYVMGWVRQAPGKEREFVAAISWSGSNRKVSDSVKGRFTISRDNSKNTLYLQMNSLRAEDTAVYYCAASNRLYGRTWYDFNESDYWGQGTQVTVSS

SEQ ID NO: 9299 - protein, 126 aa, synthetic construct
QVQLVESGGGVVQPGRSLRLSCAASGRTFGIYVMGWVRQAPGKEREFVAAISWSGSNRMVSDSVKGRFTISRDNSKNTLYLQMNSLRAEDTAVYYCAASNRLYGRTWYDFNESDYWGQGTQVTVSS

SEQ ID NO: 9300 - protein, 126 aa, synthetic construct
QVQLVESGGGVVQPGRSLRLSCAASGRTFGIYVMGWVRQAPGKEREFVAAISWSGSNRPVSDSVKGRFTISRDNSKNTLYLQMNSLRAEDTAVYYCAASNRLYGRTWYDFNESDYWGQGTQVTVSS

SEQ ID NO: 9301 - protein, 126 aa, synthetic construct
QVQLVESGGGVVQPGRSLRLSCAASGRTFGIYVMGWVRQAPGKEREFVAAISWSGSNRSVSDSVKGRFTISRDNSKNTLYLQMNSLRAEDTAVYYCAASNRLYGRTWYDFNESDYWGQGTQVTVSS

SEQ ID NO: 9302 - protein, 126 aa, synthetic construct
QVQLVESGGGVVQPGRSLRLSCAASGRTFGIYVMGWVRQAPGKEREFVAAISWSGSNRTVSDSVKGRFTISRDNSKNTLYLQMNSLRAEDTAVYYCAASNRLYGRTWYDFNESDYWGQGTQVTVSS

SEQ ID NO: 9303 - protein, 126 aa, synthetic construct
QVQLVESGGGVVQPGRSLRLSCAASGRTFGIYVMGWVRQAPGKEREFVAAISWSGSNRYVSDSVKGRFTISRDNSKNTLYLQMNSLRAEDTAVYYCAASNRLYGRTWYDFNESDYWGQGTQVTVSS

SEQ ID NO: 9304 - protein, 126 aa, synthetic construct
QVQLVESGGGVVQPGRSLRLSCAASGRTFGIYVMGWVRQAPGKEREFVAAISWSGSNRLYSDSVKGRFTISRDNSKNTLYLQMNSLRAEDTAVYYCAASNRLYGRTWYDFNESDYWGQGTQVTVSS

SEQ ID NO: 9305 - protein, 126 aa, synthetic construct
QVQLVESGGGVVQPGRSLRLSCAASGRTFGIYVMGWVRQAPGKEREFVAAISWSGSNRLVSDSVKGQFTISRDNSKNTLYLQMNSLRAEDTAVYYCAASNRLYGRTWYDFNESDYWGQGTQVTVSS

SEQ ID NO: 9306 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAAENRLYGRTWYDFNESDYWGQGTQVTVSS

SEQ ID NO: 9307 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAAHNRLYGRTWYDFNESDYWGQGTQVTVSS

SEQ ID NO: 9308 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAAYNRLYGRTWYDFNESDYWGQGTQVTVSS

SEQ ID NO: 9309 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAAQNRLYGRTWYDFNESDYWGQGTQVTVSS

SEQ ID NO: 9310 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASERLYGRTWYDFNESDYWGQGTQVTVSS

SEQ ID NO: 9311 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNKLYGRTWYDFNESDYWGQGTQVTVSS

SEQ ID NO: 9312 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRAYGRTWYDFNESDYWGQGTQVTVSS

SEQ ID NO: 9313 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRQYGRTWYDFNESDYWGQGTQVTVSS

SEQ ID NO: 9314 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRHYGRTWYDFNESDYWGQGTQVTVSS

SEQ ID NO: 9315 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRKYGRTWYDFNESDYWGQGTQVTVSS

SEQ ID NO: 9316 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRMYGRTWYDFNESDYWGQGTQVTVSS

SEQ ID NO: 9317 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRFYGRTWYDFNESDYWGQGTQVTVSS

SEQ ID NO: 9318 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRPYGRTWYDFNESDYWGQGTQVTVSS

SEQ ID NO: 9319 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRTYGRTWYDFNESDYWGQGTQVTVSS

SEQ ID NO: 9320 - protein, 126 aa, synthetic construct
QVQLVESGGGVVQPGRSLRLSCAASGRTFGIYVMGWVRQAPGKEREFVAAISWSGSNRLVSDSVKGRFTISRDNSKNTLYLQMNSLRAEDTAVYYCAASNRWYGRTWYDFNESDYWGQGTQVTVSS

SEQ ID NO: 9321 - protein, 126 aa, synthetic construct
QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNRLYGRTWYDFNESDYWGQGTQVTVSS

SEQ ID NO: 9322 - protein, 126 aa, synthetic construct
QVQLVESGGGVVQPGRSLRLSCAASGRTFGIYVMGWYRQAPGKEREFVAAMSWSGSNRKVSDSVKGRFTISRDNSKNTLYLQMNSLRAEDTAVYYCAASNKLYGRTWYDFNESDYWGQGTQVTVSS

SEQ ID NO: 9323 - protein, 126 aa, synthetic construct
QVQLVESGGGVVQPGRSLRLSCAASGRTFGIYVMGWYRQAPGKEREFVAAISWSGSNRKVSDSVKGRFTISRDNSKNTLYLQMNSLRAEDTAVYYCAASNKLYGRTWYDFNESDYWGQGTQVTVSS

SEQ ID NO: 9324 - protein, 126 aa, synthetic construct
QVQLVESGGGVVQPGRSLRLSCAASGRTFGIYVMGWYRQAPGKEREFVAAMSWSGSNRKVSDSVKGRFTISRDNSKNTLYLQMNSLRAEDTAVYYCAASNRWYGRTWYDFNESDYWGQGTQVTVSS

SEQ ID NO: 9325 - protein, 126 aa, synthetic construct
QVQLVESGGGVVQPGRSLRLSCAASGRTFGIYVMGWYRQAPGKEREFVAAISWSGSNRKVSDSVKGRFTISRDNSKNTLYLQMNSLRAEDTAVYYCAASNRWYGRTWYDFNESDYWGQGTQVTVSS

SEQ ID NO: 9326 - protein, 126 aa, synthetic construct
QVQLVESGGGVVQPGRSLRLSCAASGRTFGIYVMGWYRQAPGKEREFVAAMSWSGSNRKVSDSVKGRFTISRDNSKNTLYLQMNSLRAEDTAVYYCAASNRYYGRTWYDFNESDYWGQGTQVTVSS

SEQ ID NO: 9327 - protein, 126 aa, synthetic construct
QVQLVESGGGVVQPGRSLRLSCAASGRTFGIYVMGWYRQAPGKEREFVAAISWSGSNRKVSDSVKGRFTISRDNSKNTLYLQMNSLRAEDTAVYYCAASNRYYGRTWYDFNESDYWGQGTQVTVSS

SEQ ID NO: 9328 - protein, 126 aa, synthetic construct
QVQLVESGGGVVQPGRSLRLSCAASGRTFGIYVMGWYRQAPGKEREFVAAMSWSGSNRKVSDSVKGRFTISRDNSKNTLYLQMNSLRAEDTAVYYCAASNRLYGRTWYDFNESDYWGQGTQVTVSS

SEQ ID NO: 9329 - protein, 126 aa, synthetic construct
QVQLVESGGGVVQPGRSLRLSCAASGRTFGIYVMGWYRQAPGKEREFVAAISWSGSNRKVSDSVKGRFTISRDNSKNTLYLQMNSLRAEDTAVYYCAASNRLYGRTWYDFNESDYWGQGTQVTVSS

SEQ ID NO: 9330 - protein, 126 aa, synthetic construct
QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNKLYGRTWYDFNESDYWGQGTQVTVSS

SEQ ID NO: 9331 - protein, 126 aa, synthetic construct
QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNKLYGRTWYDFNESDYWGQGTQVTVSS

SEQ ID NO: 9332 - protein, 126 aa, synthetic construct
QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNKLYGRTWYDFNESDYWGQGTQVTVSS

SEQ ID NO: 9333 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNKLYGRTWYDFNESDYWGQGTQVTVSS

SEQ ID NO: 9334 - protein, 126 aa, synthetic construct
QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNKLYGRTWYDFNESDYWGQGTQVTVSS

SEQ ID NO: 9335 - protein, 126 aa, synthetic construct
QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNKLYGRTWYDFNESDYWGQGTQVTVSS

SEQ ID NO: 9336 - protein, 126 aa, synthetic construct
QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNKLYGRTWYDFNESDYWGQGTQVTVSS

SEQ ID NO: 9337 - protein, 126 aa, synthetic construct
QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNKLYGRTWYDFNESDYWGQGTQVTVSS

SEQ ID NO: 9338 - protein, 126 aa, synthetic construct
QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNRTYGRTWYDFNESDYWGQGTQVTVSS

SEQ ID NO: 9339 - protein, 126 aa, synthetic construct
QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNRTYGRTWYDFNESDYWGQGTQVTVSS

SEQ ID NO: 9340 - protein, 126 aa, synthetic construct
QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNRTYGRTWYDFNESDYWGQGTQVTVSS

SEQ ID NO: 9341 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNRTYGRTWYDFNESDYWGQGTQVTVSS

SEQ ID NO: 9342 - protein, 126 aa, synthetic construct
QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNRTYGRTWYDFNESDYWGQGTQVTVSS

SEQ ID NO: 9343 - protein, 126 aa, synthetic construct
QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNRTYGRTWYDFNESDYWGQGTQVTVSS

SEQ ID NO: 9344 - protein, 126 aa, synthetic construct
QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNRTYGRTWYDFNESDYWGQGTQVTVSS

SEQ ID NO: 9345 - protein, 126 aa, synthetic construct
QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNRTYGRTWYDFNESDYWGQGTQVTVSS

SEQ ID NO: 9346 - protein, 126 aa, synthetic construct
QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNRMYGRTWYDFNESDYWGQGTQVTVSS

SEQ ID NO: 9347 - protein, 126 aa, synthetic construct
QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNRMYGRTWYDFNESDYWGQGTQVTVSS

SEQ ID NO: 9348 - protein, 126 aa, synthetic construct
QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNRMYGRTWYDFNESDYWGQGTQVTVSS

SEQ ID NO: 9349 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNRMYGRTWYDFNESDYWGQGTQVTVSS

SEQ ID NO: 9350 - protein, 126 aa, synthetic construct
QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNRMYGRTWYDFNESDYWGQGTQVTVSS

SEQ ID NO: 9351 - protein, 126 aa, synthetic construct
QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNRMYGRTWYDFNESDYWGQGTQVTVSS

SEQ ID NO: 9352 - protein, 126 aa, synthetic construct
QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNRMYGRTWYDFNESDYWGQGTQVTVSS

SEQ ID NO: 9353 - protein, 126 aa, synthetic construct
QVQLVESGGGVVQPGRSLRLSCAASGRTFGIYVMGWFRQAPGKEREFVAAMSWSGSNRKVSDSVKGRFTISRDNSKNTLYLQMNSLRAEDTAVYYCAASNRMYGRTWYDFNESDYWGQGTQVTVSS

SEQ ID NO: 9354 - protein, 126 aa, synthetic construct
QVQLVESGGGVVQPGRSLRLSCAASGRTFGIYAMGWVRQAPGKEREFVGAISWSGSNRKVSDSVKGRFTISRDNSKNTLYLQMNSLRAEDTAVYYCAASNRLYGRTWYDFNESDYWGQGTQVTVSS

SEQ ID NO: 9355 - protein, 126 aa, synthetic construct
QVQLVESGGGVVQPGRSLRLSCAASGRTFGIYVFGWVRQAPGKEREFVGAISWSGSNRKVSDSVKGRFTISRDNSKNTLYLQMNSLRAEDTAVYYCAASNRLYGRTWYDFNESDYWGQGTQVTVSS

SEQ ID NO: 9356 - protein, 126 aa, synthetic construct
QVQLVESGGGVVQPGRSLRLSCAASGRTFGIYVWGWVRQAPGKEREFVGAISWSGSNRKVSDSVKGRFTISRDNSKNTLYLQMNSLRAEDTAVYYCAASNRLYGRTWYDFNESDYWGQGTQVTVSS

SEQ ID NO: 9357 - protein, 126 aa, synthetic construct
QVQLVESGGGVVQPGRSLRLSCAASGRTFGIYVMGWFRQAPGKEREFVGAISWSGSNRKVSDSVKGRFTISRDNSKNTLYLQMNSLRAEDTAVYYCAASNRLYGRTWYDFNESDYWGQGTQVTVSS

SEQ ID NO: 9358 - protein, 126 aa, synthetic construct
QVQLVESGGGVVQPGRSLRLSCAASGRTFGIYAMGWVRQAPGKEREFVAAMSWSGSNRKVSDSVKGRFTISRDNSKNTLYLQMNSLRAEDTAVYYCAASNRLYGRTWYDFNESDYWGQGTQVTVSS

SEQ ID NO: 9359 - protein, 126 aa, synthetic construct
QVQLVESGGGVVQPGRSLRLSCAASGRTFGIYVFGWVRQAPGKEREFVAAMSWSGSNRKVSDSVKGRFTISRDNSKNTLYLQMNSLRAEDTAVYYCAASNRLYGRTWYDFNESDYWGQGTQVTVSS

SEQ ID NO: 9360 - protein, 126 aa, synthetic construct
QVQLVESGGGVVQPGRSLRLSCAASGRTFGIYVWGWVRQAPGKEREFVAAMSWSGSNRKVSDSVKGRFTISRDNSKNTLYLQMNSLRAEDTAVYYCAASNRLYGRTWYDFNESDYWGQGTQVTVSS

SEQ ID NO: 9361 - protein, 8 aa, synthetic construct
ASHHHHHH

SEQ ID NO: 9362 - protein, 20 aa, synthetic construct
SGPESGPGTGTSATPESGPG

SEQ ID NO: 9363 - protein, 19 aa, synthetic construct
ATPESGPGSGPGTSESATP

SEQ ID NO: 9364 - protein, 20 aa, synthetic construct
ATPESGPGTTPGTTPESGPG

SEQ ID NO: 9365 - protein, 20 aa, synthetic construct
ATPESGPGTPPTSTPESGPG

SEQ ID NO: 9366 - protein, 20 aa, synthetic construct
ATPESGPGTSPSATPESGPG

SEQ ID NO: 9367 - protein, 20 aa, synthetic construct
ATPESGPGTGSAGTPESGPG

SEQ ID NO: 9368 - protein, 20 aa, synthetic construct
ATPESGPGTGGAGTPESGPG

SEQ ID NO: 9369 - protein, 20 aa, synthetic construct
ATPESGPGTSPGATPESGPG

SEQ ID NO: 9370 - protein, 20 aa, synthetic construct
GTPESGPGTSGSGTPESGPG

SEQ ID NO: 9371 - protein, 20 aa, synthetic construct
GTPESGPGTSSASTPESGPG

SEQ ID NO: 9372 - protein, 20 aa, synthetic construct
GTPESGPGTGAGTTPESGPG

SEQ ID NO: 9373 - protein, 20 aa, synthetic construct
GTPESGPGTGSTSTPESGPG

SEQ ID NO: 9374 - protein, 20 aa, synthetic construct
GTPETPGSEPATSGSETGTP

SEQ ID NO: 9375 - protein, 20 aa, synthetic construct
GTPEGSAPGTSTEPSESATP

SEQ ID NO: 9376 - protein, 20 aa, synthetic construct
ATPESGPGTAGSGTPESGPG

SEQ ID NO: 9377 - protein, 20 aa, synthetic construct
ATPESGPGTSSGGTPESGPG

SEQ ID NO: 9378 - protein, 20 aa, synthetic construct
ATPESGPGTAGPATPESGPG

SEQ ID NO: 9379 - protein, 20 aa, synthetic construct
ATPESGPGTPGTGTPESGPG

SEQ ID NO: 9380 - protein, 20 aa, synthetic construct
TTPESGPGTGGPTTPESGPG

SEQ ID NO: 9381 - protein, 20 aa, synthetic construct
STPESGPGTGSGSTPESGPG

SEQ ID NO: 9382 - protein, 60 aa, synthetic construct
ELVVTQEPSLTVSPGGTVTLTCRSSTGAVTTSNYANWVQQKPGQAPRGLIGGTNKRAPGT

SEQ ID NO: 9383 - protein, 60 aa, synthetic construct
ELVVTQEPSLTVSPGGTVTLTCRSSNGAVTSSNYANWVQQKPGQAPRGLIGGTNKRAPGT

SEQ ID NO: 9384 - protein, 49 aa, synthetic construct
PARFSGSLLGGKAALTLSGVQPEDEAEYYCALWYSNLWVFGGGTKLTVL

SEQ ID NO: 9385 - protein, 49 aa, synthetic construct
PARFSGSLLGGKAALTLSGVQPEDEAVYYCALWYPNLWVFGGGTKLTVL

SEQ ID NO: 9386 - protein, 60 aa, synthetic construct
EVQLLESGGGLVQPGGSLKLSCAASGFTFNTYAMNWVRQAPGKGLEWVARIRSKYNNYAT

SEQ ID NO: 9387 - protein, 60 aa, synthetic construct
EVQLLESGGGIVQPGGSLKLSCAASGFTFNTYAMNWVRQAPGKGLEWVARIRSKYNNYAT

SEQ ID NO: 9388 - protein, 60 aa, synthetic construct
EVQLVESGGGIVQPGGSLRLSCAASGFTFSTYAMNWVRQAPGKGLEWVGRIRTKRNNYAT

SEQ ID NO: 9389 - protein, 60 aa, synthetic construct
YYADSVKDRFTISRDDSKNTAYLQMNNLKTEDTAVYYCVRHGNFGNSYVSWFAYWGQGTL

SEQ ID NO: 9390 - protein, 60 aa, synthetic construct
YYADSVKDRFTISRDDSKNTVYLQMNNLKTEDTAVYYCVRHENFGNSYVSWFAHWGQGTL

SEQ ID NO: 9391 - protein, 60 aa, synthetic construct
YYADSVKGRFTISRDDSKNTVYLQMNSLKTEDTAVYYCVRHENFGNSYVSWFAHWGQGTL

SEQ ID NO: 9392 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXPESG

SEQ ID NO: 9393 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXSEGG

SEQ ID NO: 9394 - protein, 28 aa, synthetic construct
  VARIANT 5..24: note = Up to 19 X residues may be deleted
  VARIANT 5..24: note = X can be any amino acid
PEGSXXXXXXXXXXXXXXXXXXXXSEGG

SEQ ID NO: 9395 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXSETG

SEQ ID NO: 9396 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXSESA

SEQ ID NO: 9397 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXPESG

SEQ ID NO: 9398 - protein, 28 aa, synthetic construct
  VARIANT 5..24: note = Up to 19 X residues may be deleted
  VARIANT 5..24: note = X can be any amino acid
PESGXXXXXXXXXXXXXXXXXXXXPESG

SEQ ID NO: 9399 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXSEGG

SEQ ID NO: 9400 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXSETG

SEQ ID NO: 9401 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXSESA

SEQ ID NO: 9402 - protein, 28 aa, synthetic construct
  VARIANT 5..24: note = Up to 19 X residues may be deleted
  VARIANT 5..24: note = X can be any amino acid
PESGXXXXXXXXXXXXXXXXXXXXSESA

SEQ ID NO: 9403 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXPESG

SEQ ID NO: 9404 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXSEGG

SEQ ID NO: 9405 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXSETG

SEQ ID NO: 9406 - protein, 28 aa, synthetic construct
  VARIANT 5..24: note = Up to 19 X residues may be deleted
  VARIANT 5..24: note = X can be any amino acid
PETPXXXXXXXXXXXXXXXXXXXXSETG

SEQ ID NO: 9407 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXSESA

SEQ ID NO: 9408 - protein, 4 aa, synthetic construct
KERE

SEQ ID NO: 9409 - protein, 4 aa, synthetic construct
KQRE

SEQ ID NO: 9410 - protein, 4 aa, synthetic construct
GLEW

SEQ ID NO: 9411 - protein, 5 aa, synthetic construct
KEREL

SEQ ID NO: 9412 - protein, 5 aa, synthetic construct
KEREF

SEQ ID NO: 9413 - protein, 5 aa, synthetic construct
KQREL

SEQ ID NO: 9414 - protein, 5 aa, synthetic construct
KQREF

SEQ ID NO: 9415 - protein, 5 aa, synthetic construct
KEREG

SEQ ID NO: 9416 - protein, 5 aa, synthetic construct
KQREW

SEQ ID NO: 9417 - protein, 5 aa, synthetic construct
KQREG

SEQ ID NO: 9418 - protein, 4 aa, synthetic construct
TERE

SEQ ID NO: 9419 - protein, 5 aa, synthetic construct
TEREL

SEQ ID NO: 9420 - protein, 4 aa, synthetic construct
TQRE

SEQ ID NO: 9421 - protein, 5 aa, synthetic construct
TQREL

SEQ ID NO: 9422 - protein, 4 aa, synthetic construct
KECE

SEQ ID NO: 9423 - protein, 5 aa, synthetic construct
KECEL

SEQ ID NO: 9424 - protein, 5 aa, synthetic construct
KECER

SEQ ID NO: 9425 - protein, 4 aa, synthetic construct
KQCE

SEQ ID NO: 9426 - protein, 5 aa, synthetic construct
KQCEL

SEQ ID NO: 9427 - protein, 4 aa, synthetic construct
RERE

SEQ ID NO: 9428 - protein, 5 aa, synthetic construct
REREG

SEQ ID NO: 9429 - protein, 4 aa, synthetic construct
RQRE

SEQ ID NO: 9430 - protein, 5 aa, synthetic construct
RQREL

SEQ ID NO: 9431 - protein, 5 aa, synthetic construct
RQREF

SEQ ID NO: 9432 - protein, 5 aa, synthetic construct
RQREW

SEQ ID NO: 9433 - protein, 4 aa, synthetic construct
QERE

SEQ ID NO: 9434 - protein, 5 aa, synthetic construct
QEREG

SEQ ID NO: 9435 - protein, 4 aa, synthetic construct
QQRE

SEQ ID NO: 9436 - protein, 5 aa, synthetic construct
QQREW

SEQ ID NO: 9437 - protein, 5 aa, synthetic construct
QQREL

SEQ ID NO: 9438 - protein, 5 aa, synthetic construct
QQREF

SEQ ID NO: 9439 - protein, 4 aa, synthetic construct
KGRE

SEQ ID NO: 9440 - protein, 5 aa, synthetic construct
KGREG

SEQ ID NO: 9441 - protein, 4 aa, synthetic construct
KDRE

SEQ ID NO: 9442 - protein, 5 aa, synthetic construct
KDREV

SEQ ID NO: 9443 - protein, 5 aa, synthetic construct
DECKL

SEQ ID NO: 9444 - protein, 5 aa, synthetic construct
NVCEL

SEQ ID NO: 9445 - protein, 4 aa, synthetic construct
GVEW

SEQ ID NO: 9446 - protein, 4 aa, synthetic construct
EPEW

SEQ ID NO: 9447 - protein, 4 aa, synthetic construct
GLER

SEQ ID NO: 9448 - protein, 4 aa, synthetic construct
DQEW

SEQ ID NO: 9449 - protein, 4 aa, synthetic construct
DLEW

SEQ ID NO: 9450 - protein, 4 aa, synthetic construct
GIEW

SEQ ID NO: 9451 - protein, 4 aa, synthetic construct
ELEW

SEQ ID NO: 9452 - protein, 4 aa, synthetic construct
GPEW

SEQ ID NO: 9453 - protein, 4 aa, synthetic construct
EWLP

SEQ ID NO: 9454 - protein, 4 aa, synthetic construct
GPER

The invention claimed is:

1. A polypeptide comprising the amino acid sequence of SEQ ID NO:1000.

2. The polypeptide of claim 1, which consists of the amino acid sequence of SEQ ID NO:1000.

3. A pharmaceutical composition, comprising the polypeptide of claim 1 and one or more pharmaceutically suitable excipients.

4. A method of treating a cancer in a subject, comprising administering to the subject the pharmaceutical composition of claim 3, wherein the cancer is characterized with expression of prostate-specific membrane antigen (PSMA).

5. The method of claim 4, wherein the cancer is prostate cancer.

6. A polynucleotide encoding the polypeptide of claim 1.

7. A vector, comprising the polynucleotide of claim 6 and a recombinant regulatory sequence operably linked to the polynucleotide.

8. A host cell, comprising the vector of claim 7.

* * * * *